(12) United States Patent
Raum et al.

(10) Patent No.: US 11,884,720 B2
(45) Date of Patent: Jan. 30, 2024

(54) ANTIBODY CONSTRUCTS FOR MSLN AND CD3

(71) Applicants: AMGEN RESEARCH (MUNICH) GMBH, Munich (DE); AMGEN INC., Thousand Oaks, CA (US)

(72) Inventors: Tobias Raum, Munich (DE); Jonas Anlahr, Munich (DE); Julie Bailis, Los Gatos, CA (US); Claudia Blümel, Munich (DE); Patrick Hoffmann, Munich (DE); Peter Kufer, Munich (DE); Elisabeth Nahrwold, Munich (DE); Doris Rau, Munich (DE)

(73) Assignees: AMGEN RESEARCH (MUNICH) GMBH, Munich (DE); AMGEN INC., Thousand Oaks, CA (US)

( * ) Notice: Subject to any disclaimer, the term of this patent is extended or adjusted under 35 U.S.C. 154(b) by 0 days.

(21) Appl. No.: 15/225,423

(22) Filed: Aug. 1, 2016

(65) Prior Publication Data

US 2017/0029502 A1    Feb. 2, 2017

Related U.S. Application Data

(60) Provisional application No. 62/290,861, filed on Feb. 3, 2016, provisional application No. 62/199,939, filed on Jul. 31, 2015.

(51) Int. Cl.
C07K 16/28    (2006.01)
C07K 16/30    (2006.01)

(52) U.S. Cl.
CPC .......... *C07K 16/28* (2013.01); *C07K 16/2809* (2013.01); *C07K 16/30* (2013.01); *C07K 2317/31* (2013.01); *C07K 2317/33* (2013.01); *C07K 2317/56* (2013.01); *C07K 2317/565* (2013.01); *C07K 2317/622* (2013.01); *C07K 2317/73* (2013.01); *C07K 2317/92* (2013.01); *C07K 2317/94* (2013.01)

(58) Field of Classification Search
CPC . C07K 16/2809; C07K 2317/31; C07K 16/28
USPC .......................................... 424/133.1, 135.1
See application file for complete search history.

(56) References Cited

U.S. PATENT DOCUMENTS

| | | | |
|---|---|---|---|
| 3,691,016 A | 9/1972 | Patel et al. |
| 3,773,919 A | 11/1973 | Boswell et al. |
| 3,969,287 A | 7/1976 | Jaworek et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,301,144 A | 11/1981 | Iwashita et al. |
| 4,330,440 A | 5/1982 | Ayers et al. |
| 4,439,196 A | 3/1984 | Higuchi |
| 4,447,224 A | 5/1984 | DeCant, Jr. et al. |
| 4,447,233 A | 5/1984 | Mayfield |
| 4,475,196 A | 10/1984 | La Zor |
| 4,485,045 A | 11/1984 | Regen |
| 4,486,194 A | 12/1984 | Ferrara |
| 4,487,603 A | 12/1984 | Harris |
| 4,496,689 A | 1/1985 | Mitra |
| 4,544,545 A | 10/1985 | Ryan et al. |
| 4,596,556 A | 6/1986 | Morrow et al. |
| 4,640,835 A | 2/1987 | Shimizu et al. |
| 4,670,417 A | 6/1987 | Iwasaki et al. |
| 4,694,778 A | 9/1987 | Learn et al. |
| 4,751,180 A | 6/1988 | Cousens et al. |
| 4,790,824 A | 12/1988 | Morrow et al. |
| 4,791,192 A | 12/1988 | Nakagawa et al. |
| 4,816,397 A | 3/1989 | Boss et al. |
| 4,816,567 A | 3/1989 | Cabilly et al. |
| 4,935,233 A | 6/1990 | Bell et al. |
| 4,941,880 A | 7/1990 | Burns |
| 4,946,778 A | 8/1990 | Ladner et al. |
| 5,013,556 A | 5/1991 | Woodle et al. |
| 5,064,413 A | 11/1991 | McKinnon et al. |
| 5,223,409 A | 6/1993 | Ladner et al. |
| 5,225,539 A | 7/1993 | Winter |
| 5,260,203 A | 11/1993 | Ladner et al. |
| 5,292,658 A | 3/1994 | Cormier et al. |

(Continued)

FOREIGN PATENT DOCUMENTS

| | | |
|---|---|---|
| CL | 2014001254 A1 | 10/2014 |
| CL | 2014001263 A1 | 10/2014 |

(Continued)

OTHER PUBLICATIONS

Beatty et al. (Cancer Immunol Res. Feb. 1, 2014; 2(2): 112-120).*
Yuan et al. (Journal of Hematology & Oncology 2014, 7:1-14).*
Lutterbuese, R. et al., Proc. Natl. Acad. Sci. USA 107, 12605-12610 (2010).*
Brinkman et al. (MABS vol. 9, No. 2, 182-212 (2017)).*
U.S. Appl. No. 07/466,008, Kucherlapati et al.
U.S. Appl. No. 07/574,748, Kay et al.
U.S. Appl. No. 07/575,962, Lonberg et al.
U.S. Appl. No. 07/610,515, Kucherlapati et al.
U.S. Appl. No. 07/904,068, Lonberg et al..

(Continued)

*Primary Examiner* — Lynn A Bristol
(74) *Attorney, Agent, or Firm* — MARSHALL, GERSTEIN & BORUN LLP

(57) ABSTRACT

The present invention relates to a bispecific antibody construct comprising a first binding domain which binds to human MSLN on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

23 Claims, 22 Drawing Sheets

Figure 1B:
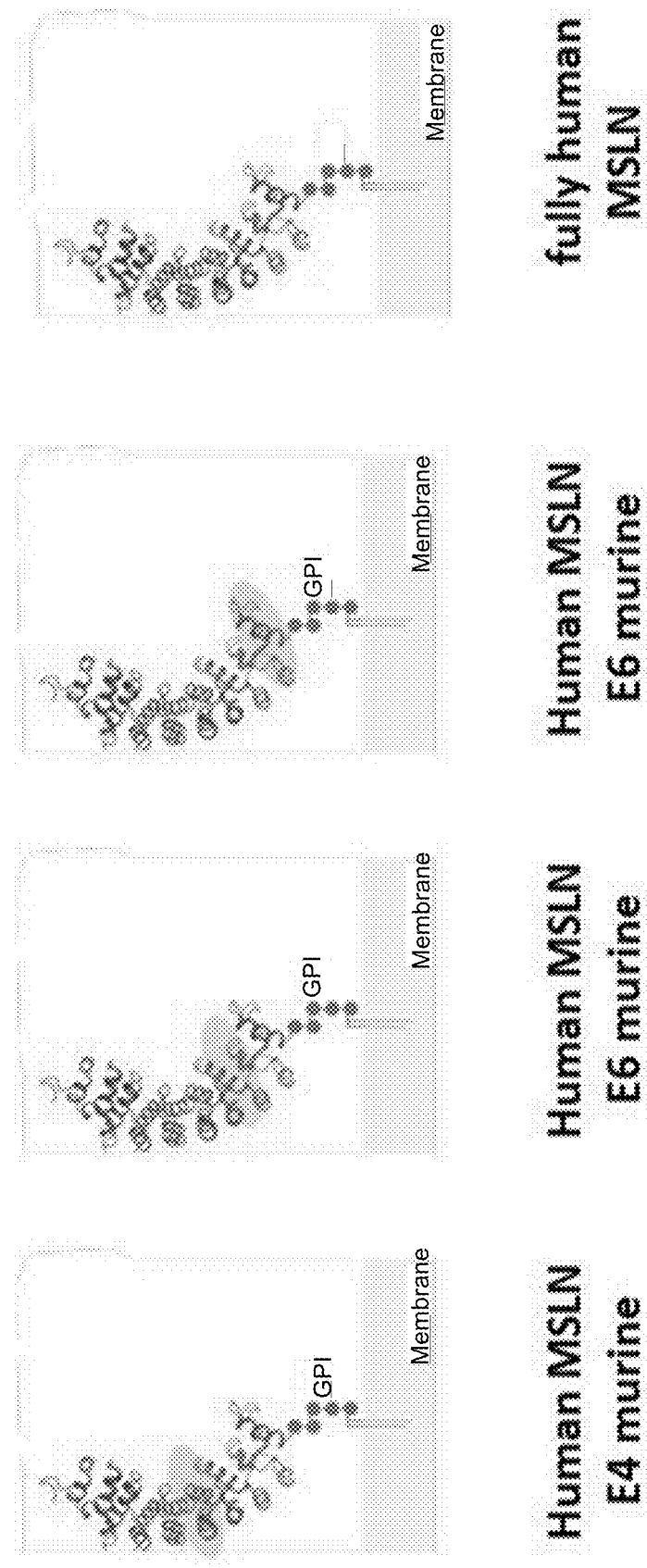

Specification includes a Sequence Listing.

(56) References Cited

U.S. PATENT DOCUMENTS

| | | |
|---|---|---|
| 5,312,335 A | 5/1994 | McKinnon et al. |
| 5,383,851 A | 1/1995 | McKinnon, Jr. et al. |
| 5,399,163 A | 3/1995 | Peterson et al. |
| 5,418,155 A | 5/1995 | Cormier et al. |
| 5,476,996 A | 12/1995 | Wilson et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,585,089 A | 12/1996 | Queen et al. |
| 5,591,669 A | 1/1997 | Krimpenfort et al. |
| 5,612,205 A | 3/1997 | Kay et al. |
| 5,625,126 A | 4/1997 | Lonberg et al. |
| 5,625,825 A | 4/1997 | Rostoker et al. |
| 5,633,425 A | 5/1997 | Lonberg et al. |
| 5,643,763 A | 7/1997 | Dunn et al. |
| 5,648,260 A | 7/1997 | Winter et al. |
| 5,661,016 A | 8/1997 | Lonberg et al. |
| 5,683,888 A | 11/1997 | Campbell |
| 5,693,761 A | 12/1997 | Queen et al. |
| 5,693,762 A | 12/1997 | Queen et al. |
| 5,698,767 A | 12/1997 | Wilson et al. |
| 5,721,367 A | 2/1998 | Kay et al. |
| 5,741,668 A | 4/1998 | Ward et al. |
| 5,770,429 A | 6/1998 | Lonberg et al. |
| 5,777,079 A | 7/1998 | Tsien et al. |
| 5,789,215 A | 8/1998 | Berns et al. |
| 5,789,650 A | 8/1998 | Lonberg et al. |
| 5,804,387 A | 9/1998 | Cormack et al. |
| 5,814,318 A | 9/1998 | Lonberg et al. |
| 5,859,205 A | 1/1999 | Adair et al. |
| 5,874,299 A | 2/1999 | Lonberg et al. |
| 5,874,304 A | 2/1999 | Zolotukhin et al. |
| 5,876,995 A | 3/1999 | Bryan |
| 5,877,397 A | 3/1999 | Lonberg et al. |
| 5,925,558 A | 7/1999 | Tsien et al. |
| 5,939,598 A | 8/1999 | Kucherlapati et al. |
| 5,958,765 A | 9/1999 | Brams et al. |
| 5,981,175 A | 11/1999 | Loring et al. |
| 6,023,010 A | 2/2000 | Krimpenfort et al. |
| 6,075,181 A | 6/2000 | Kucherlapati et al. |
| 6,114,598 A | 9/2000 | Kucherlapati et al. |
| 6,150,584 A | 11/2000 | Kucherlapati et al. |
| 6,162,963 A | 12/2000 | Kucherlapati et al. |
| 6,255,458 B1 | 7/2001 | Lonberg et al. |
| 6,300,064 B1 | 10/2001 | Knappik et al. |
| 6,407,213 B1 | 6/2002 | Carter et al. |
| 6,632,424 B1 | 10/2003 | Lyman et al. |
| 6,673,986 B1 | 1/2004 | Kucherlapati et al. |
| 7,575,923 B2 | 8/2009 | Dorken et al. |
| 7,628,986 B2 | 12/2009 | Weber et al. |
| 8,911,732 B2 | 12/2014 | Dennis et al. |
| 9,034,324 B2 | 5/2015 | Kalled et al. |
| 9,096,672 B2 | 8/2015 | Weber et al. |
| 9,150,664 B2 | 10/2015 | Kufer et al. |
| 9,243,058 B2 | 1/2016 | Armitage et al. |
| 9,340,621 B2 | 5/2016 | Kufer et al. |
| 9,567,399 B1* | 2/2017 | Campbell ........... C07K 16/2803 |
| 9,598,500 B2 | 3/2017 | Kufer et al. |
| 9,617,338 B1* | 4/2017 | Campbell ........... C07K 16/2803 |
| 9,718,893 B2 | 8/2017 | Jung et al. |
| 9,725,506 B2 | 8/2017 | Dillon et al. |
| 9,765,157 B2* | 9/2017 | Xiao ..................... A61K 47/60 |
| 9,767,858 B2 | 9/2017 | Bonakdar et al. |
| 9,850,320 B2* | 12/2017 | Bernett ............... C07K 16/468 |
| 9,856,327 B2* | 1/2018 | Bernett ............... C07K 16/468 |
| 10,220,090 B2 | 3/2019 | Armitage et al. |
| 10,294,300 B2 | 5/2019 | Raum et al. |
| 10,301,391 B2 | 5/2019 | Raum et al. |
| 10,519,241 B2 | 12/2019 | Raum et al. |
| 2002/0160004 A1 | 10/2002 | Lyman et al. |
| 2003/0070185 A1 | 4/2003 | Jakobovits et al. |
| 2005/0076395 A1 | 4/2005 | Kucherlapati et al. |
| 2008/0260738 A1 | 10/2008 | Moore et al. |
| 2009/0304696 A1 | 12/2009 | Lawson et al. |
| 2010/0150918 A1 | 6/2010 | Kufer et al. |
| 2010/0267617 A1 | 10/2010 | Baseman et al. |
| 2011/0275787 A1 | 11/2011 | Kufer et al. |
| 2011/0293579 A1 | 12/2011 | Nielsen et al. |
| 2011/0293619 A1 | 12/2011 | Kufer et al. |
| 2013/0129723 A1 | 5/2013 | Blankenship et al. |
| 2013/0129729 A1 | 5/2013 | Kischel et al. |
| 2013/0156769 A1 | 6/2013 | Kufer et al. |
| 2013/0156770 A1 | 6/2013 | Kufer et al. |
| 2013/0273055 A1 | 10/2013 | Borges et al. |
| 2013/0287774 A1 | 10/2013 | Zugmaier et al. |
| 2014/0004121 A1* | 1/2014 | Fanslow, III ......... C07K 16/30 424/139.1 |
| 2014/0088295 A1 | 3/2014 | Smith et al. |
| 2014/0128326 A1 | 5/2014 | Cameron et al. |
| 2014/0154253 A1* | 6/2014 | Ng ..................... C07K 16/2803 424/136.1 |
| 2014/0200331 A1 | 7/2014 | Corper et al. |
| 2014/0242079 A1 | 8/2014 | Bacac et al. |
| 2014/0288275 A1 | 9/2014 | Moore et al. |
| 2014/0302037 A1 | 10/2014 | Borges et al. |
| 2014/0308285 A1* | 10/2014 | Yan .................... C07K 16/468 424/136.1 |
| 2014/0348837 A1 | 11/2014 | Kufer et al. |
| 2015/0023967 A1 | 1/2015 | Kufer et al. |
| 2015/0037334 A1* | 2/2015 | Kufer ................... A61P 31/00 435/69.6 |
| 2015/0166661 A1 | 6/2015 | Chen et al. |
| 2015/0368343 A1 | 12/2015 | Xiao et al. |
| 2015/0376287 A1 | 12/2015 | Vu et al. |
| 2016/0032019 A1* | 2/2016 | Xiao ................... C07K 16/468 424/136.1 |
| 2016/0115241 A1* | 4/2016 | Yan .................... C07K 16/2803 424/136.1 |
| 2016/0168263 A1 | 6/2016 | Bigner et al. |
| 2016/0176973 A1 | 6/2016 | Kufer et al. |
| 2016/0257748 A1* | 9/2016 | Michaels ............... C07K 16/28 |
| 2016/0340440 A1* | 11/2016 | Fanslow, III ......... C07K 16/30 |
| 2017/0029502 A1* | 2/2017 | Raum .................... C07K 16/30 |
| 2017/0029512 A1 | 2/2017 | Raum et al. |
| 2017/0037130 A1 | 2/2017 | Raum et al. |
| 2017/0037149 A1 | 2/2017 | Raum et al. |
| 2017/0121420 A1 | 5/2017 | Heidrich et al. |
| 2017/0129961 A1 | 5/2017 | Raum et al. |
| 2017/0165373 A1 | 6/2017 | Armitage et al. |
| 2017/0209571 A1* | 7/2017 | Kanapuram ........... A61K 47/10 |
| 2017/0218077 A1 | 8/2017 | Raum et al. |
| 2017/0218078 A1* | 8/2017 | Raum .................... A61P 37/02 |
| 2017/0218079 A1 | 8/2017 | Raum et al. |
| 2017/0247476 A1* | 8/2017 | Yan ...................... C07K 16/468 |
| 2017/0275373 A1* | 9/2017 | Kufer ................... C07K 16/30 |
| 2017/0349668 A1* | 12/2017 | Rattel ..................... A61P 37/00 |
| 2017/0362321 A1* | 12/2017 | Campbell ........... C07K 16/2827 |
| 2018/0002450 A1* | 1/2018 | Xiao ....................... A61P 35/04 |
| 2018/0016352 A1* | 1/2018 | Thurecht ............... C07K 16/44 |
| 2019/0151448 A1* | 5/2019 | Abel ..................... A61K 47/26 |
| 2019/0169295 A1* | 6/2019 | Kufer ................. C07K 16/3069 |
| 2019/0263907 A1 | 8/2019 | Raum et al. |

FOREIGN PATENT DOCUMENTS

| | | |
|---|---|---|
| CL | 2015000713 A1 | 7/2015 |
| CL | 2015001988 A1 | 11/2015 |
| CL | 2015002071 A1 | 6/2016 |
| CL | 2016000363 A1 | 10/2016 |
| CL | 2016001556 A1 | 2/2017 |
| CL | 2015002742 A1 | 3/2017 |
| CL | 2016000564 A1 | 3/2017 |
| CL | 2017000278 A1 | 11/2017 |
| CL | 2017001090 A1 | 1/2018 |
| CL | 2017001361 A1 | 2/2018 |
| CL | 2017001866 A1 | 4/2018 |
| CL | 2017002641 A1 | 4/2018 |
| CL | 2016002460 A1 | 5/2018 |
| CL | 2018000263 A1 | 10/2018 |
| CL | 2018000267 A1 | 10/2018 |
| CL | 2018000268 A1 | 10/2018 |
| CL | 2018000269 A1 | 10/2018 |

(56) References Cited

FOREIGN PATENT DOCUMENTS

| | | |
|---|---|---|
| CL | 2018000270 A1 | 10/2018 |
| CL | 2018001175 A1 | 10/2018 |
| CL | 2018000431 A1 | 11/2018 |
| CL | 2018002063 A1 | 11/2018 |
| CL | 2018002057 A1 | 2/2019 |
| CL | 2019000146 A1 | 4/2019 |
| CL | 2019000726 A1 | 5/2019 |
| CL | 2019000738 A1 | 5/2019 |
| CL | 2019000119 A1 | 6/2019 |
| CL | 2019001198 A1 | 7/2019 |
| CN | 104829726 A | 8/2015 |
| CN | 104829728 A | 8/2015 |
| EP | 0036676 A1 | 9/1981 |
| EP | 0058481 A1 | 8/1982 |
| EP | 0088046 A2 | 9/1983 |
| EP | 0133988 A2 | 3/1985 |
| EP | 0143949 A1 | 6/1985 |
| EP | 0171496 A2 | 2/1986 |
| EP | 0173494 A2 | 3/1986 |
| EP | 0183070 A2 | 6/1986 |
| EP | 0239400 A2 | 9/1987 |
| EP | 0244234 A2 | 11/1987 |
| EP | 0402226 A1 | 12/1990 |
| EP | 0463151 A1 | 1/1992 |
| EP | 0546073 A1 | 6/1993 |
| EP | 0773288 A2 | 5/1997 |
| EP | 0843961 A1 | 5/1998 |
| EP | 2647707 A1 | 10/2013 |
| EP | 2840091 A1 | 2/2015 |
| GB | 2177096 A | 1/1987 |
| JP | 3 068 180 B2 | 7/2000 |
| JP | 3 068 506 B2 | 7/2000 |
| JP | 3 068 507 B2 | 7/2000 |
| WO | WO-1987/005330 A1 | 9/1987 |
| WO | WO-1988/01649 A1 | 3/1988 |
| WO | WO-1988/009344 A1 | 12/1988 |
| WO | 1991/10741 A1 | 7/1991 |
| WO | WO-1992/003918 A1 | 3/1992 |
| WO | WO-1992/015673 A1 | 9/1992 |
| WO | WO-1992/022645 A1 | 12/1992 |
| WO | WO-1992/022647 A1 | 12/1992 |
| WO | WO-1992/022670 A1 | 12/1992 |
| WO | WO-1993/012227 A1 | 6/1993 |
| WO | WO-1993/015722 A1 | 8/1993 |
| WO | WO-94/00569 A1 | 1/1994 |
| WO | WO-1994/002602 A1 | 2/1994 |
| WO | WO-1994/010308 A1 | 5/1994 |
| WO | WO-1994/025585 A1 | 11/1994 |
| WO | WO-1995/007463 A1 | 3/1995 |
| WO | WO-1996/014436 A1 | 5/1996 |
| WO | WO-1996/033735 A1 | 10/1996 |
| WO | WO-1996/034096 A1 | 10/1996 |
| WO | WO-1997/013852 A1 | 4/1997 |
| WO | WO-1997/038731 A1 | 10/1997 |
| WO | WO-1998/014605 A1 | 4/1998 |
| WO | WO-1998/024884 A1 | 6/1998 |
| WO | WO-1998/024893 A2 | 6/1998 |
| WO | WO-1998/026277 A2 | 6/1998 |
| WO | WO-1998/052976 A1 | 11/1998 |
| WO | WO-1999/049019 A2 | 9/1999 |
| WO | WO-1999/054440 A1 | 10/1999 |
| WO | WO-2000/006605 A2 | 2/2000 |
| WO | WO-2000/034317 A2 | 6/2000 |
| WO | WO-2000/076310 A1 | 12/2000 |
| WO | WO-2003/047336 A2 | 6/2003 |
| WO | WO-2005/010151 A2 | 2/2005 |
| WO | WO-2005/040220 A1 | 5/2005 |
| WO | 2005/077981 A1 | 8/2005 |
| WO | WO-2006/138181 A2 | 12/2006 |
| WO | WO-2007/042261 A2 | 4/2007 |
| WO | WO-2007/098420 A2 | 8/2007 |
| WO | WO-2008/119567 A2 | 10/2008 |
| WO | WO-2008/131242 A1 | 10/2008 |
| WO | WO-2008/143954 A2 | 11/2008 |
| WO | WO-2009/127691 A1 | 10/2009 |
| WO | 2010/037836 A2 | 4/2010 |
| WO | WO-2010/037838 A2 | 4/2010 |
| WO | WO-2010/045261 A1 | 4/2010 |
| WO | WO-2010/124797 A1 | 11/2010 |
| WO | WO-2011/051489 A2 | 5/2011 |
| WO | WO-2011/076922 A1 | 6/2011 |
| WO | 2011/121110 A1 | 10/2011 |
| WO | WO-2012/059486 A1 | 5/2012 |
| WO | WO-2013/072406 A1 | 5/2012 |
| WO | WO-2012/088461 A2 | 6/2012 |
| WO | WO-2012/150319 A1 | 11/2012 |
| WO | WO-2013/026833 A1 | 2/2013 |
| WO | WO-2013/026837 A1 | 2/2013 |
| WO | 2013/075048 A1 | 5/2013 |
| WO | WO-2013/072415 A1 | 5/2013 |
| WO | WO-2013/075066 A1 | 5/2013 |
| WO | WO-2013/092001 A1 | 6/2013 |
| WO | WO-2013/126746 A2 | 8/2013 |
| WO | WO-2013/128027 A1 | 9/2013 |
| WO | WO-2013/135896 A1 | 9/2013 |
| WO | WO-2013/185010 A1 | 12/2013 |
| WO | WO-2014/004549 A2 | 1/2014 |
| WO | WO-2014/031476 A1 | 2/2014 |
| WO | WO-2014/047231 | 3/2014 |
| WO | WO-2014/072481 A1 | 5/2014 |
| WO | 2014/100490 A1 | 6/2014 |
| WO | WO-2014/114800 A1 | 7/2014 |
| WO | WO-2014/125273 A1 | 8/2014 |
| WO | WO-2014/131712 A1 | 9/2014 |
| WO | WO-2014/138449 A1 | 9/2014 |
| WO | WO-2014/140248 A1 | 9/2014 |
| WO | WO-2014/140358 A1 | 9/2014 |
| WO | WO-2014/144722 A2 | 9/2014 |
| WO | WO-2014/151910 A1 | 9/2014 |
| WO | WO-2014/153063 A1 | 9/2014 |
| WO | WO-2015/006482 A1 | 1/2015 |
| WO | WO-2015/018527 A1 | 2/2015 |
| WO | WO-2015/026894 A2 | 2/2015 |
| WO | WO-2015/036583 A2 | 3/2015 |
| WO | WO-2015/048272 A1 | 4/2015 |
| WO | 2015/063187 A1 | 5/2015 |
| WO | WO-2015/095392 A1 | 6/2015 |
| WO | 2015/107015 A1 | 7/2015 |
| WO | WO-2015/149077 A1 | 10/2015 |
| WO | 2015/181805 A1 | 12/2015 |
| WO | WO-2016/016859 A1 | 2/2016 |
| WO | WO-2016/020309 A1 | 2/2016 |
| WO | WO-2016/071355 A1 | 5/2016 |
| WO | WO-2016/086189 A2 | 6/2016 |
| WO | WO-2016/086196 A2 | 6/2016 |
| WO | WO-2016/116626 A1 | 7/2016 |
| WO | WO-2016/166360 A1 | 10/2016 |
| WO | WO-2017/021349 A1 | 2/2017 |
| WO | WO-2017/021354 A1 | 2/2017 |
| WO | WO-2017/021356 A1 | 2/2017 |
| WO | WO-2017/021362 A1 | 2/2017 |
| WO | WO-2017/031104 A1 | 2/2017 |
| WO | WO-2017/079121 A2 | 5/2017 |
| WO | 2017/134140 A1 | 8/2017 |
| WO | WO-2017/134134 A1 | 8/2017 |
| WO | WO-2017/134158 A1 | 8/2017 |
| WO | WO-2018/015340 A1 | 1/2018 |
| WO | WO-2018/017786 A2 | 1/2018 |
| WO | WO-2018/058001 A1 | 3/2018 |
| WO | WO-2018/067331 A1 | 4/2018 |
| WO | WO-2018/083204 A1 | 5/2018 |

OTHER PUBLICATIONS

U.S. Appl. No. 07/919,297, Kucherlapati et al.
U.S. Appl. No. 08/112,848, Kucherlapati et al.
U.S. Appl. No. 08/155,301, Lonberg et al.
U.S. Appl. No. 08/161,739, Lonberg et al.
U.S. Appl. No. 08/165,699, Lonberg et al.
U.S. Appl. No. 08/209,741, Kay et al.
U.S. Appl. No. 08/234,145, Kucherlapati et al.
U.S. Appl. No. 08/376,279, Kucherlapati et al.
U.S. Appl. No. 08/430,938, Kucherlapati et al.

(56) References Cited

OTHER PUBLICATIONS

U.S. Appl. No. 08/462,837, Kucherlapati et al.
U.S. Appl. No. 08/463,191, Kucherlapati et al.
U.S. Appl. No. 08/464,584, Kucherlapati et al.
U.S. Appl. No. 08/486,853.
U.S. Appl. No. 08/486,859.
U.S. Appl. No. 08/759,620, Jakobovits et al.
Altschul et al., Basic local alignment tool. *J. Mol. Biol.* 215: 403-10 (1990).
Altschul et al., Gapped BLAST and PSI-BLAST: a new generation of protein database search programs. *Nucl. Acids Res.* 25(17): 3389-402 (1997).
Altschul et al., Gapped BLAST and PSI-BLAST: a new generation of protein database search programs. *Nucl. Acids Res.* 25: 3389-402 (1993).
Altschul et al., Local alignment statistics. *Meth. Enzymol.* 266: 460-80 (1996).
Aplin et al., Preparation, properties, and applications of carbohydrate conjugates of proteins and lipids. *CRC Crit. Rev. Biochem.* 259-306 (1981).
Arakawa et al., Solvent interactions in pharmaceutical formulations. *Pharm. Res.* 8(3): 285-91 (1991).
Artsaenko et al., The expression of a single-chain Fv antibody against abscisic acid creates a wilty phenotype in transgenic tobacco. *The Plant J.* 8: 745-50 (1995).
Brühl et al., Depletion of CCR5-expressing cells with bispecific antibodies and chemokine toxins: a new strategy in the treatment of chronic inflammatory diseases and HIV. *Immunol.* 166: 2420-6 (2001).
Carter et al., High level *Escherichia coli* expression and production of a bivalent humanized antibody fragment. *Biotechnology* 10: 163-7 (1992).
Chalfie et al., Green fluorescent protein as a marker for gene expression. *Science* 263: 802-5 (1994).
Chang et al., Molecular cloning of mesothelin, a differentiation antigen present on mesothelium, mesotheliomas, and ovarian cancers. *Proc. Natl. Acad. Sci. USA* 93(1): 136-40 (1996).
Cheadle et al., Cloning and expression of the variable regions of mouse myeloma protein MOPC315 in *E. coli*: recovery of active FV fragments. *Mol. Immunol.* 29: 21-30 (1992).
Cheson et al., Report of an international workshop to standardize response criteria for non-Hodgkin's lymphomas. NCI Sponsored International Working Group. *J. Clin. Oncol.* 17(4): 1244 (1999).
Chothia et al., Canonical structures for the hypervariable regions of immunoglobulins. *J. Mol. Biol.* 196: 901-17 (1987).
Chothia et al., Conformation of immunoglobulin hypervariable regions. *Nature* 342: 877-83 (1989).
Clackson et al., Making antibody fragments using phage display libraries. *Lett. Nature* 352: 624-8 (1991).
Cook et al., The human immunoglobulin VH repertoire. *Immunol. Today* 16(5): 237-42 (1995).
Cunningham et al., High-resolution epitope mapping of hGH-receptor interactions by alanine-scanning mutagenesis. *Science* 244: 1081-5 (1989).
Dall'Acqua et al., Contribution of domain interface residues to the stability of antibody CH3 domain homodimers. *Biochemistry* 37: 9266-73 (1998).
Devereux et al., A comprehensive set of sequence analysis programs for the VAX. *Nucl. Acid. Res.* 12: 387-95 (1984).
Duskin et al., Relationship of the structure and biological activity of the natural homologues of tunicamycin. *J. Biol. Chem.* 257(6): 3105-9 (1982).
Edge et al., Deglycosylation of glycoproteins by trifluoromethanesulfonic acid. *Anal. Biochem.* 118: 131-7 (1981).
Eppstein et al., Biological activity of liposome-encapsulated murine interferon γ is mediated by a cell membrane receptor. *Proc. Natl. Acad. Sci. USA* 82: 3688-92 (1985).
Fanslow et al., Structural characteristics of CD40 ligand that determine biological function. *Semin. Immunol.* 6: 267-78 (1994).

Fecker et al., Expression of single-chain antibody fragments (scFv) specific for beet necrotic yellow vein virus coat protein or 25 kDa protein in *Escherichia coli* and *Nicotiana benthamiana*. *Plant Mol. Biol.* 32: 979-86 (1996).
Feng et al., Progressive sequence alignment as a prerequisite to correct phylogenetic trees. *J. Mol. Evol..* 35: 351-60 (1987).
Gabizon et al., Pharmacokinetics and tissue distribution of doxorubicin encapsulated in stable liposomes with long circulation times. *J. Natl. Cancer Inst.* 8: 1484-8 (1989).
Graham et al., Characteristics of a human cell line transformed by DNA from human adenovirus type 5. *J. Gen. Virol.* 36: 59-74 (1977).
Green et al., Antigen-specific human monoclonal antibodies from mice engineered with human Ig heavy and light chain YACs. *Nat. Genet.* 7: 13-21 (1994).
Green et al., Regulation of B cell development by variable gene complexity in mice reconstituted with human immunoglobulin yeast artificial chromosomes. *J. Exp. Med.* 188: 483-95 (1998).
Hakimuddin et al., A chemical method for the deglycosylation of proteins. *Arch. Biochem. Biophys.* 259: 52-7 (1987).
Hawkins et al., Selection of phage antibodies by binding affinity. *J. Mol. Biol.* 254: 889-96 (1992).
Heim et al., Engineering green fluorescent protein for improved brightness, longer wavelengths and fluorescence resonance energy transfer. *Curr. Biol.* 6: 178-82 (1996).
Hiatt et al., Production of antibodies in transgenic plants. *Nature* 342: 76-8 (1989).
Higgins et al., Fast and sensitive multiple sequence alignments on a microcomputer. *CABIOS* 5: 151-3 (1989).
Holliger et al., "Diabodies": small bivalent and bispecific antibody fragments. *Proc. Natl. Acad. Sci. USA* 90(14): 6444-8 (1993).
Hoppe et al., A parallel three stranded alpha-helical bundle at the nucleation site of collagen triple-helix formation. *FEBS Lett.* 344: 191-5 (1994).
Huston et al., Protein engineering of antibody binding sites: recovery of specific activity in an anti-digoxin single-chain Fv analogue produced in *Escherichia coli*. *Proc. Natl. Acad. Sci. USA* 85: 5879-83 (1988).
Hwang et al., Hepatic uptake and degradation of unilamellar sphingomyelin/cholesterol liposomes: A kinetic study. *Proc. Natl. Acad. Sci. USA* 77: 4030-4 (1980).
Ichiki et al., Regulation of the expression of human C epsilon germline transcript. Identification of a novel IL-4 responsive element. *J. Immunol.* 150: 5408-17 (1993).
Jones et al., Replacing the complementarity-determine regions in a human antibody with those from a mouse. *Nature* 321: 522-5 (1986).
Karlin et al., Applications and statistics for multiple high-scoring segments in molecular sequences. *Proc. Natl. Acad. Sci. USA* 90: 5873-7 (1993).
Kaufman, Selection and coamplification of heterologous genes in mammalian cells. *Meth. Enzymol.* 185: 537-66 (1990).
Kendrick et al., Physical stabilization of proteins in aqueous solution, in: Rational design of stable protein formulations: theory and practice. Carpenter and Manning (eds.), *Pharmaceutical Biotechnology* 13: 61-84 (2002).
Kipriyanov et al., Bispecific tandem diabody for tumor therapy with improved antigen binding and pharmacokinetics. *J. Mol. Biol.* 293: 41-56 (1999).
Knappe et al., Herpesvirus saimiri-transformed macaque T cells are tolerated and do not cause lymphoma after autologous reinfusion. *Blood* 95(10): 3256-61 (2000).
Kohler et al., Continuous cultures of fused cells secreting antibody of predefined specificity. *Nature* 256:495-7 (1975).
Kozbor et al., The production of monoclonal antibodies from human lymphocytes. *Immunol. Today* 4(3): 72-9 (1983).
Kufer et al., A revival of bispecific antibodies. *Trends Biotechnol.* 22(5): 238-44 (2004).
Kufer et al., Construction and biological activity of a recombinant bispecific single-chain antibody designed for therapy of minimal residual colorectal cancer. *Cancer Immunol. Immunother.* 45: 193-7 (1997).

(56) References Cited

OTHER PUBLICATIONS

Landschulz et al., The leucine zipper: a hypothetical structure common to a new class of DNA binding proteins. *Science* 240: 1759-64 (1988).
Langer et al., Biocompatibility of polymeric delivery systems for macromolecules. *J. Biomed. Mater. Res.* 15(2): 267-77 (1981).
Langer, Controlled release of macromolecules, *Chem. Tech.* 12: 98-105 (1982).
Lowman et al., Selecting high-affinity binding proteins by monovalent phage display. *Biochemistry* 30: 10832-7 (1991).
Löffler et al., A recombinant bispecific single-chain antibody, CD19 x CD3, induces rapid and high lymphoma-directed cytotoxicity by unstimulated T lymphocytes. *Blood* 95(6): 2098-103 (2000).
MacCallum et al., Antibody-antigen intractions: Contact analysis and binding site technology. *J. Mol. Biol.* 262: 732-45 (1996).
Mack et al., A small bispecific antibody construct expressed as a functional single-chain molecule with high tumor cell cytotoxicity. *Proc. Natl. Acad. Sci. USA* 92(15): 7021-5 (1995).
Mack et al., Biologic properties of a bispecific single-chain antibody directed against 17-1A (EpCAM) and CD3: tumor cell-dependent T cell stimulation and cytotoxic activity. *J. Immunol.* 158: 3965-70 (1997).
Malmborg et al., BIAcore as a tool in antibody engineering. *J. Immunol. Meth.* 183: 7-13 (1995).
Marks et al., By-passing immunization: Human antibodies from V-gene libraries displayed on phage. *J. Mol. Biol.* 222:581-97 (1991).
Martin et al., Irreversible coupling of immunoglobulin fragments to preformed vesicles. *J. Biol. Chem.* 257: 286-8 (1982).
Martin et al., Structural families in loops of homologous proteins: automatic classification, modelling and application to antibodies. *J. Mol. Biol.* 263: 800-15 (1996).
Mather et al., Culture of testicular cells in hormone-supplemented serum-free medium. *Ann. N.Y. Acad. Sci.* 383: 44-68 (1982).
Mather, Establishment and characterization of two distinct mouse testicular epithelial cell lines.*Biol. Reprod.* 23: 243-51 (1980).
Mendez et al., Functional transplant of megabase human immunoglobulin loci recapitulates human antibody response in mice. *Nat. Genet.* 15: 146-56 (1997).
Morrison et al., Chimeric human antibody molecules: mouse antigen-binding domains with human constant region domains. *Proc. Natl. Acad. Sci. USA* 81: 6851-5 (1984).
Morrison et al., Combinatorial alanine-scanning. *Curr. Opin. Chem. Biol.* 5(3): 302-7 (2001).
Morrison, Transfectomas provide novel chimeric antibodies. *Science* 229(4719): 1202-7 (1985).
Needleman et al., A general method applicable to the search for similarities in the amino acid sequence of two proteins. *J. Mol. Biol.* 48: 443-53 (1970).
Nolan et al., Fluorescence-activated cell analysis and sorting of viable mammalian cells based on beta-D-galactosidase activity after transduction of *Escherichia coli* lacZ. *Proc. Natl. Acad. Sci. USA* 85: 2603-7 (1988).
Olsson et al., Human-human monoclonal antibody-producing hybridomas: Technical aspects. *Meth. Enzymol.* 92: 3-16 (1982).
Owen et al., Synthesis of a functional anti-phytochrome single-chain Fv protein in transgenic tobacco. *Bio/Technology* 10: 790-4 (1992).
Padlan, Anatomy of the antibody molecule. *Molec. Immunol.* 31(3): 169-217 (1993).
Pearson et al., Improved tools for biological sequence comparison. *Proc. Natl. Acad. Sci. USA* 85:2444-8 (1988).
Presta, Antibody engineering. *Curr. Op. Struct. Biol.* 2: 593-6 (1992).
Raag et al., Single-chain Fvs. *FASEB J.* 9(1): 73-80 (1995).
Randolph et al., Surfactant-protein interactions. *Pharm Biotechnol.* 13: 159-75 (2002).
Raum et al., Anti-self antibodies selected from a human IgD heavy chain repertoire: a novel approach to generate therapeutic human antibodies against tumor-associated differentiation antigens. *Cancer Immunol. Immunother.* 50: 141-50 (2001).
Riechmann et al., Reshaping human antibodies for therapy. *Nature* 332: 323-9 (1988).
Schier et al., Efficient in vitro affinity maturation of phage antibodies using BIAcore guided selections. *Hum. Antibodies Hybridomas* 7(3): 97-105 (1996).
Schlereth et al., T-cell activation and B-cell depletion in chimpanzees treated with a bispecific anti-CD19/anti-CD3 single-chain antibody construct. *Cancer Immunol. Immunother.* 55: 503-14 (2006).
Sidman et al., Controlled release of macromolecules and pharmaceuticals from synthetic polypeptides based on glutamic acid. *Biopolymers* 2: 547-56 (1983).
Smith et al., Comparison of biosequences. *Adv. Appl. Math.* 2: 482-9 (1981).
Smith, Filamentous fusion phage: novel expression vectors that display cloned antigens on the virion surface. *Science* 228: 1315-7 (1985).
Songsivilai et al., Bispecific antibody: a tool for diagnosis and treatment of disease. *Clin. Exp. Immunol.* 79: 315-21 (1990).
Stauber et al., Development and applications of enhanced green fluorescent protein mutants. *Biotechniques* 24: 462-71 (1998).
Takeda et al., Construction of chimaeric processed immunoglobulin genes containing mouse variable and human constant region sequences. *Nature* 314: 452-4 (1985).
Teng et al., Construction and testing of mouse-human heteromyelomas for human monoclonal antibody production. *Proc. Natl. Acad. Sci. USA.* 80: 7308-12 (1983).
Thotakura et al., Enzymatic deglycosylation of glycoproteins. *Meth. Enzymol.* 138: 350-9 (1987).
Tomlinson et al., The repertoire of human germline VH sequences reveals about fifty groups of VH segments with different hypervariable loops. *J. Mol. Biol.* 227: 776-98 (1992).
Tomlinson et al., The structural repertoire of the human V kappa domain. *EMBO J.* 14: 4628-38 (1995).
Urlaub et al., Isolation of Chinese hamster cell mutants deficient in dihydrofolate reductase activity. *Proc. Natl. Acad. Sci. USA,* 77: 4216-20 (1980).
Ward et al., Binding activities of a repertoire of single immunoglobulin variable domains secreted from *Escherichia coli. Lett. Nature* 341: 544-6 (1989).
Beckman et al., Antibody constructs in cancer therapy, *Cancer* 109(2): 170-79 (2007).
Bird et al., Single-chain antigen-binding proteins. *Science* 242: 423-26 (1988).
Choi et al., Systemic administration of a bispecific antibody targeting EGFRvIII sucessfully treats intracerebral glioma, *Proc. Natl. Acad. Sci. USA* 110(1): 270-75 (2013).
Durben et al., Characterization of a Bispecific FLT3 X CD3 Antibody in an Improved, Recombinant Format for the Treatment of Leukemia,*Molecular Therapy,* 23: 648-655 (2015).
Emlet et al., Targeting a glioblastoma cancer stem-cell population defined by EGF receptor variant III. *Cancer Res.* 74(4): 1238-49 (2014).
Fujimori et al., A modeling analysis of monoclonal antibody percolation through tumors: A binding-site barrier, *J. Nuc. Med.* 31(7): 1191-98 (1990).
Garcia de Palazzo et al., Expression of mutated epidermal growth factor receptor by non-small cell lung carcinomas. *Cancer Res.* 53(14): 3217-20 (1993).
Ge et al., Evidence of high incidence of EGFRvIII expression and coexpression with EGFR in human invasive breast cancer by laser capture microdissection and immunohistochemical analysis. *Int. J. Cancer* 98(3): 357-61 (2002).
Gussow et al., Humanization of monoclonal antibodies, *Methods in Enzymology* 203: 99-121 (1991).
Hay et al., Clinical development success rates for investigational drugs, *Nature Biotechnology* 32(1): 40-51 (2014).
Hoffmann et al., "Generation, selection and preclinical characterization of an Fc-optimized FLT3 antibody for the treatment of myeloid leukemia," *Leukemia* 26: 1228-1237 (2012).
Holt et al., Domain antibodies: proteins for therapy, *Trends in Biotech* 21 (11):484-89 (2003).

(56) References Cited

OTHER PUBLICATIONS

Hwang et al., Use of human germline genes in a CDR homology-based approach to antibody humanization. *Methods* 36(1): 35-42 (2005).
Jubala et al., CD20 expression in normal canine B cells and in canine non hodgkin-lymphoma, *Vet Pathol.* 42: 468-76 (2005).
Lippincott-Schwartz, Antibodies as call biological tools, *Current Protocols in Cell Biology* 16.0.1-16.0.2 (2002).
Moscatello et al., Frequent expression of a mutant epidermal growth factor receptor in multiple human tumors. Cancer Res. 55(23): 5536-9 (1995).
Olapade-Olaopa et al., Evidence for the differential expression of a variant EGF receptor protein in human prostate cancer. *Br. J. Cancer* 82(1): 186-94 (2000).
Rouet et al., Fully human VH single domains that rival the stability and cleft recognition of camelid antibodies, *J. Biol. Chem.* 290(19): 11905-17 (2015).
Rudikoff et al., Single amino acid substitution altering antigen-binding specificity, *Proc. Natl. Acad. Sci. USA* 79: 1979-1983 (1982).
Rudnick et al., Affinity and avidity in antibody-based tumor targeting, *Cancer Biotherapy and Radio Pharmaceuticals* 24(2): 155-61 (2009).
Skerra et al., Assembly of a functional immunoglobulin Fv fragment in *Escherichia coli. Science,* 242: 1038-41 (1988).
Thurber et al., Antibody tumor penetration: Transport opposed by systemic and antigen-mediated clearance, *Adv. Drug Deliv. Rev.* 60: 1421-34 (2008).
Wikstrand et al., Monoclonal antibodies against EGFRvIII are tumor specific and react with breast and lung carcinomas and malignant gliomas. *Cancer Res.* 55(14): 3140-8 (1995).
Wu et al., Humanization of a murine monoclonal antibody by simultaneous optimization of framework and CDR residues, *J. Mol. Biol.* 294: 151-62 (1999).
International Search Report and Written Opinion corresponding to International Application No. PCT/EP2016/068319, dated Nov. 23, 2016.
International Search Report and Written Opinion corresponding to International Application No. PCT/EP2017/052212, dated Jul. 4, 2017.
International Search Report and Written Opinion corresponding to International Application No. PCT/EP2016/068332, dated Nov. 28, 2016.
International Search Report and Written Opinion corresponding to International Application No. PCT/EP2016/068304, dated Nov. 29, 2016.
Chu et al., Immunotherapy with Long-Lived Anti-CD123 x Anti-CD3 Bispecific Antibodies Stimulates Potent T Cell-Mediated Killing of Human AML Cell Lines and CD123+ Cells in Monkeys: A Potential Therapy for Acute Myelogenous Leukemia. 616. Acute Myeloid Leukemia: Novel Therapy, excluding Transplantation: Poster II, Dec. 6, 2014. *Blood.* 124(21):2316 (2014).
Kelly et al., Mesothelin-targeted agents in clinical trials and in preclinical development, Mol. *Cancer Ther.* 11:517-25 (2012).
Schatz, Efficacy and candidate biomarker evaluation for the anti-mesothelin antibody drug conjugate (ADC) BAY 94-9343, mesothelin-ADC in mesothelin-positive preclinical xenograft models; In: Proceedings of the 103rd Annual Meeting of the American Association for Cancer Research; Mar. 31-Apr. 4, 2012; Chicago, IL. Philadelphia (PA): AACR; Cancer Res 2012;72(8 Suppl):Abstract 2726. doi:1538-7445.AM2012-2726.
Chu et al., Immunotherapy with long-lived anti-CD20 x Anti-CD3 bispecific antibodies stimulates potent T Cell-mediated killing of human B cell lines and of circulating and lymphoid B Cells lymphomas and leukemias, Blood (2014).
Feulner et al., Abstract:A novel CD33/CD3-bispecific BiTE antibody can effectively recruit autologous T cells from AML-patients for in vitro cell lysis of CD33+ blasts, Proceedings of the 103rd Annual Meeting of the American Association for Cancer Research, Chicago, IL (2012) (Abstract).
Krupka et al., CD33 target validation and sustained depletion of AML blasts in long-term cultures by the bispecific T-cell-engaging antibody AMG 330, *Blood.* 123:356-65 (2014).
Lu et al., Tetravalent anti-CD20/CD3 bispecific antibody for the treatment of B cell lymphoma, *Biochem. Biophys. Res. Commun.* 473:808-13 (2016).
Sun et al., Anti-CD20/CD3 T cell-dependent bispecific antibody for the treatment of B cell malignancies, *Sci. Transl. Med.* 7:287ra70 (2015).
Topp et al., Anti-CD19 BITE Blinatumomab induces high complete remission rate in adult patients with relapsed B-precursor ALL: Updated Results of an ongoing phase II trial, *Blood, American Society of Hematology, US.* 118:252(2011).
Walter RB, Investigational CD33-targeted therapeutics for acute myeloid leukemia, *Expert Opin. Investig. Drugs.* 27:339-48 (2018).
Yeung et al., An Optimized Full-Length FLT3/CD3 Bispecific Antibody Demonstrates Potent Anti-leukemia Activity and Reversible Hematological Toxicity, *Mol. Ther.* S1525-0016(20)30009-5 (2020).
Zugmaier et al., Clinical overview of anti-CD19 BiTE® and ex vivo data from anti-CD33 BITE® as examples for retargeting T cells in hematologic malignancies, *Mol. Immunol.* 67:58-66 (2015).
Smith et al., The challenges of genome sequence annotation or "The devil is in the details", Nat. Biotech., 15:1222-1223 (1997).
Smith-Gill et al., Contributions of immunoglobulin heavy and light chains to antibody specificity for lysozyme and two haptens, J. Immunol., 139:4135-4144 (1987).
Sokoloff et al., A dual-monoclonal sandwich assay for prostate-specific membrane antigen: levels in tissues, seminal fluid and urine, Prostate, 43:150-157 (2000).
Song et al. Light chain of natural antibody plays a dominant role in protein antigen binding, Biochem. Biophys. Res. Comm., 268: 390-394 (2000).
Sutherland et al., Targeting BAFF: immunomodulation for autoimmune diseases and lymphomas, Pharmacol. Ther., 112:774-786 (2006).
Sweat et al., Prostate-specific membrane antigen expression is greatest in prostate adenocarcinoma and lymph node metastases, Urology, 52:637-640 (1998).
Tai et al., Targeting B-cell maturation factor antigen in multiple myeloma, Immunother., 7(11):1187-1199 (2015).
Tokuriki et al., Stability effects of mutations and protein evolvability, Curr. Opin. Structural. Biol., 19:596-604 (2009).
Troyer et al., Detection and characterization of the prostate-specific membrane antigen (PSMA) in tissue extracts and body fluids, Int. J. Cancer, 62:552-558 (1995).
Wells, Additivity of mutational effects in proteins, Biochemistry, 29(37):8509-8517 (1990).
Wright et al., Upregulation of prostate-specific membrane antigen after androgen-deprivation therapy, Urology, 48:326-334 (1996).
Zhou et al., Single chain Fc-dimer-human growth hormone fusion protein for improved drug delivery, Biomaterials, 117:24-31 (2017).
Zou et al., Immunotherapy based on bispecific T-cell engager with hIgG1 Fc sequence as a new therapeutic strategy in multiple myeloma, Cancer Sci., 106(5):512-521 (2015).
Andersen et al., Extending serum half-life of albumin by engineering FcRn binding, J. Biol. Chem., 289(19):13492-13502 (2014).
Bacac et al., A novel carcinoembryonic antigen T-Cell bispecific antibody (CEA TCB) for the treatment of solid tumors, Clin. Cancer Res., 22(13):3286-3297 (2016).
Bellucci et al., Graft-versus-tumor response in patients with multiple myeloma is associated with antibody response to BCMA, a plasma-cell membrane receptor, Blood, 105(10):3945-3950 (2005).
Bork et al. Go hunting in sequence databases but watch out for the traps, Trends in Genetics, 12(10): 425-427 (1996).
Bork, Powers and pitfalls in sequence analysis: the 70% hurdle, Genome. Res., 10:398-400 (2000).
Brenner, Errors in genome annotation, Trends Genet., 15(4):132-133 (1999).
Brummell et al., Probing the combining site of an anti-carbohydrate antibody by saturation-mutagenesis: role of the heavy-chain CDR3 residues, Biochemistry, 32:1180-1187 (1993).

(56) References Cited

OTHER PUBLICATIONS

Burger et al., Expression analysis of delta-catenin and prostate-specific membrane antigen: their potential as diagnostic markers for prostate cancer, Int. J. Cancer, 100:228-237 (2002).
Burks et al., In vitro scanning saturation mutagenesis of an antibody binding pocket, Proc. Natl. Acad. Sci., 94:412-417 (1997).
Carpenter et al., B-cell maturation antigen is a promising target for adoptive T-cell therapy of multiple myeloma, Clin. Cancer Res., 19(8): 2048-2060 (2013).
Casset et al., A peptide mimetic of an anti-CD4 monoclonal antibody by rational design, Biochemical and Biophysical Research Communications, 307: 198-205 (2003).
Chang et al., Comparison of anti-prostate-specific membrane antigen antibodies and other immunomarkers in metastatic prostate carcinoma, Urology, 57:1179-1183 (2001).
Chang et al., Five different anti-prostate-specific membrane antigen (PSMA) antibodies confirm PSMA expression in tumor-associated neovasculature, Cancer Res., 59:3192-3198 (1999).
Cheng et al., Structural design of disialoganglioside GD2 and CD3-bispecific antibodies to redirect T cells for tumor therapy, Int. J. Cancer, 136(2):476-486 (2015).
Colman, Effects of amino acid sequence changes on antibody-antigen interactions, Res. Immunol., 145:33-36 (1994).
Coquery et al., Regulatory roles the tumor necrosis factor receptor BCMA, Crit. Rev. Immunol., 32(4):287-305 (2010).
Doerks et al., Protein annotation: detective work for function prediction, Trends in Genetics, 14(6):248-250 (1998).
Fortmuller et al., Effective targeting of prostate cancer by lymphocytes redirected by a PSMA?×?CD3 bispecific single-chain diabody, Prostate., 71(6):588-596 (2011).
Friedrich et al., Regression of human prostate cancer xenografts in mice by AMG 212/BAY2010112, a novel PSMA/CD3-Bispecific BiTE antibody cross-reactive with non-human primate antigens, Mol. Cancer Ther., 11(12):2664-2673 (2012).
Ha et al., Immunoglobulin Fc heterodimer platform technology: From design to applications in therapeutic antibodies and proteins, Front. Immunol., 7(394):1-16 (2016).
Horoszewicz et al., Monoclonal antibodies to a new antigenic marker in epithelial prostatic cells and serum of prostatic cancer patients, Anticancer Res., 7:927-935 (1987).
Hubert et al., STEAP: a prostate-specific cell-surface antigen highly expressed in human prostate tumors, Pros. Natl. Acad. Sci. USA, 96:14523-14528 (1999).
Huntington et al., A BAFF antagonist suppresses experimental autoimmune encephalomyelitis by targeting cell-mediated and humoral immune responses, Int. Immunol., 18(10):1473-1485 (2006).
International Application No. PCT/EP2017/052239, International Preliminary Report on Patentability, dated Aug. 16, 2018.
International Application No. PCT/EP2017/052239, International Search Report and Written Opinion, dated May 11, 2017.
Israeli et al., Expression of the prostate-specific membrane antigen, Cancer Res., 54:1807-1811 (1994).
Israeli et al., Molecular cloning of a complementary DNA encoding a prostate-specific membrane antigen, Cancer Res., 53:227-230 (1993).
Jang et al., The structural basis for DNA binding by an anti-DNA autoantibody, Mol. Immunol., 35:1207-1217 (1998).
Kawakami et al., Enhanced expression of prostate-specific membrane antigen gene in prostate cancer as revealed by in situ hybridization, Cancer Res., 57:2321-2324 (1997).
Kobayashi et al., Tryptophan H33 plays an important role in pyrimidine (6-4) pyrimidone photoproduct binding by a high-affinity antibody, Protein Eng., 12:879-884 (1999).
Kontermann, Dual targeting strategies with bispecific antibodies, mAbs. 4(2):182-197 (2012).
Kumar et al., Molecular cloning and expression of the Fabs of human autoantibodies in *Escherichia coli,* Determination of the heavy or light chain contribution to the anti-DNA/-cardiolipin activity of the Fab, J. Biol. Chem., 275:35129-35136 (2000).
Kuo et al., Engineering a CD123xCD3 bispecific scFv immunofusion for the treatment of leukemia and elimination of leukemia stem cells, Protein Eng. Des. Sel., 25(10):561-570 (2012).
Liu et al., Monoclonal antibodies to the extracellular domain of prostate-specific membrane antigen also react with tumor vascular endothelium, Cancer Res., 57:3629-3634 (1997).
Lopes et al., Immunohistochemical and pharmacokinetic characterization of the site-specific immunoconjugate CYT-356 derived from antiprostate monoclonal antibody 7E11-C5, Cancer Res., 50:6423-6429 (1990).
Matthias et al., Regression of human prostate cancer xenografts in mice by AMG 212/BAY2010112, a novel PSMA/CD3-Bispecific BiTE antibody cross-reactive with non-human primate antigens, Molecular Cancer Therapeutics, 11(12): 2664-2673 (2002).
Moisini et al., BAFF: a local and system target in autoimmune disease, Clin. Exp. Immunol., 158:155-163 (2009).
Murphy et al., Evaluation and comparison of two new prostate carcinoma markers, Free-prostate specific antigen and prostate specific membrane antigen, Cancer, 78:809-818 (1996).
Ngo et al., Computational complexity, protein structure prediction, and the Levinthal paradox, The Protein Folding Problem and Tertiary Structure Prediction, 492-495 (1994).
Novak et al., Expression of BCMA, TACI, and BAFF-R in multiple myeloma: a mechanism for growth and survival, Blood, 103:689-694 (2004).
O'Keefe et al., Mapping, genomic organization and promoter analysis of the human prostate-specific membrane antigen gene, Biochem. Biophys. Acta., 1443:113-127 (1998).
Paul, William E., Fundamental Immunology, 3rd Edition, Raven Press, New York, Chapt. 8, 292-295.
Pelletier et al., Comparison of soluble decoy IgG fusion proteins of BAFF-R and BCMA as antagonists for BAFF, J. Biol. Chem., 278(35):33127-33133 (2003).
Reiter et al., Prostate stem cell antigen: a cell surface marker overexpressed in prostate cancer, Proc. Nat. Acad. Sci. USA, 95:1735-1740 (1998).
Rennert et al., A soluble form of B Cell maturation factor antigen, a receptor for the tumor necrosis factor family member APRIL, inhibits tumor cell growth., J. Exp. Med., 192(11):1677-1683 (2000).
Ross et al., Correlation of primary tumor prostate-specific membrane antigen expression with disease recurrence in prostate cancer, Clin. Cancer Res., 9:6357-6362 (2003).
Ryan et al., Antibody targeting of B-cell maturation factor antigen on malignant plasma cells, Mol. Cancer Ther., 6(11):3009-3018 (2007).
Schliemann et al., An essential role for BAFF in the normal development of B cells through a BCMA-independent pathway, Science, 293(5537):2111-2114 (2001).
Sewell et al., 319 Ant-PSMA X Anti-CD3 Bispecific Antibody Efficiently Redirects T Cell Cytotoxicity in Castrate-resistant prostate cancer models, European Journal of Cancer, Elsevier, Amsterdam, NL, 48(6):98 (2012).
Skolnick et al., From genes to protein structure and function: novel applications of computational approaches in the genomic era, Trends in Biotech., 18(1):34-39 (2000).
NCBI Accession No. AJN78919.1, Anti-mesothelin antibodies and immunoconjugates, dated Feb. 14, 2015.

\* cited by examiner

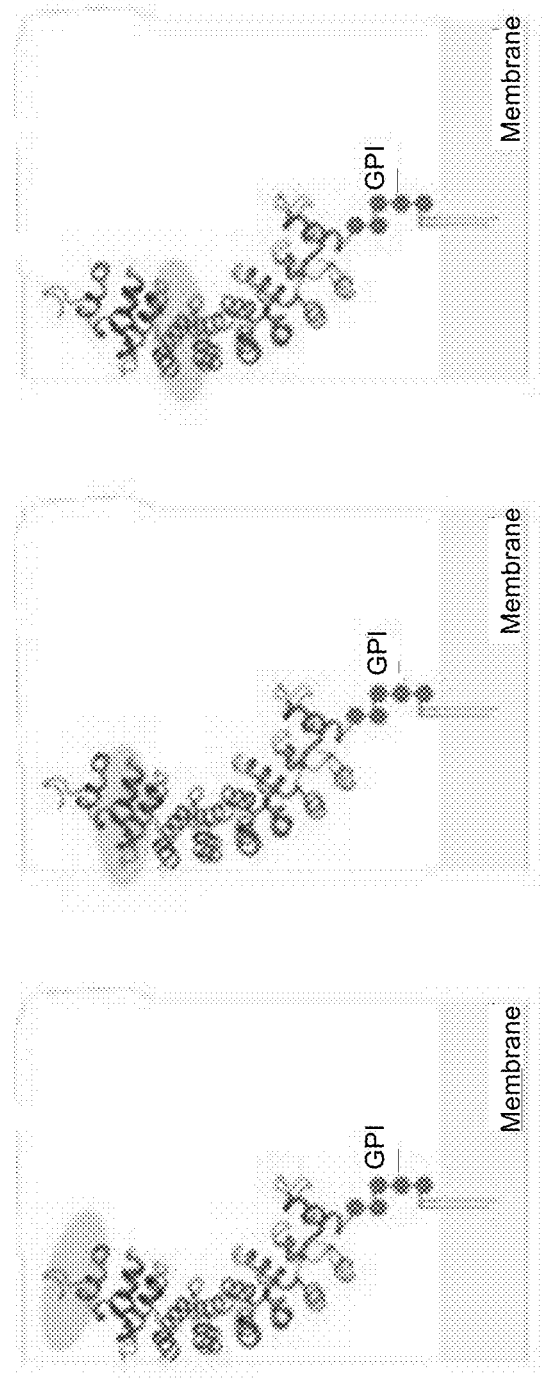

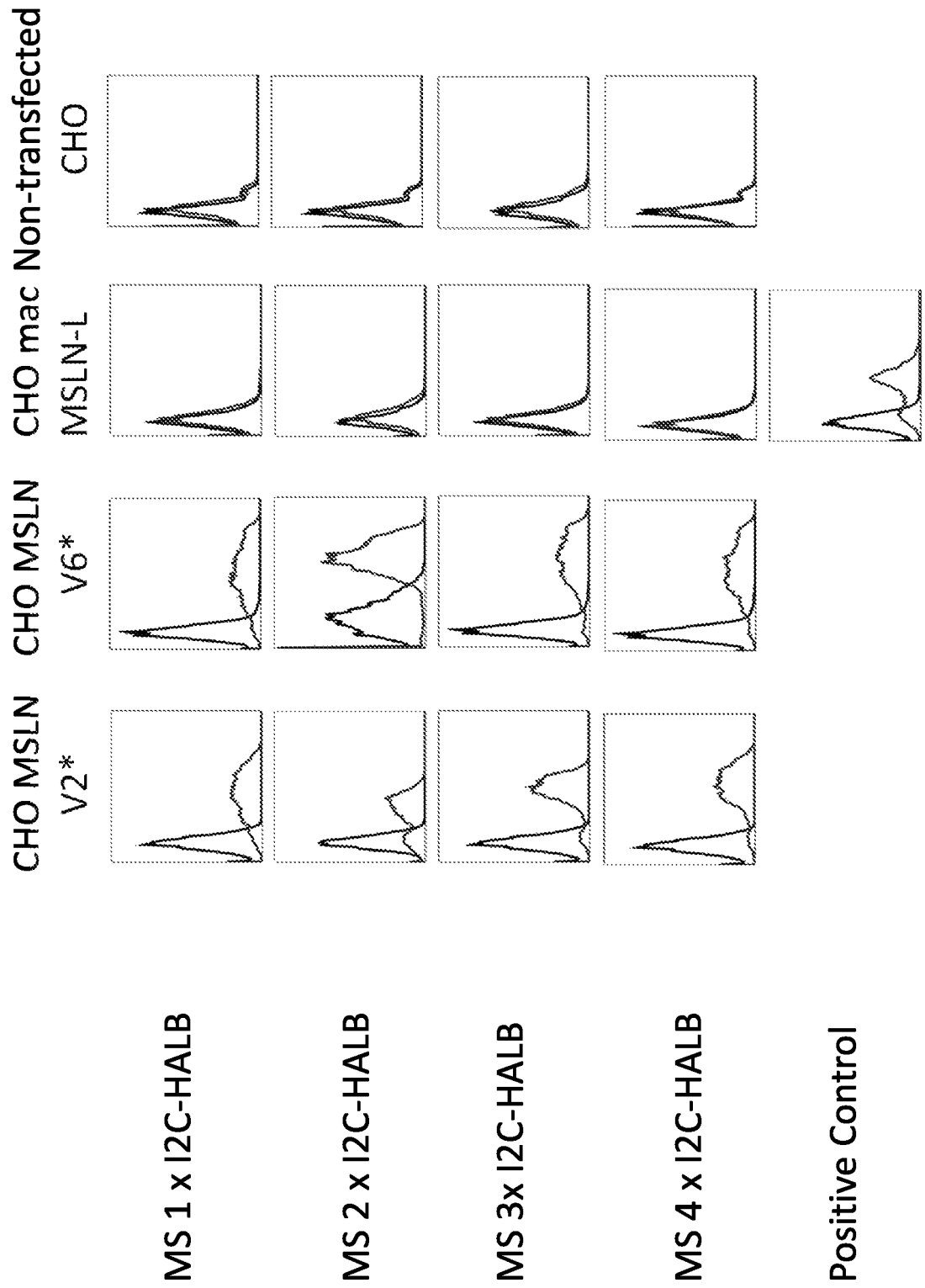

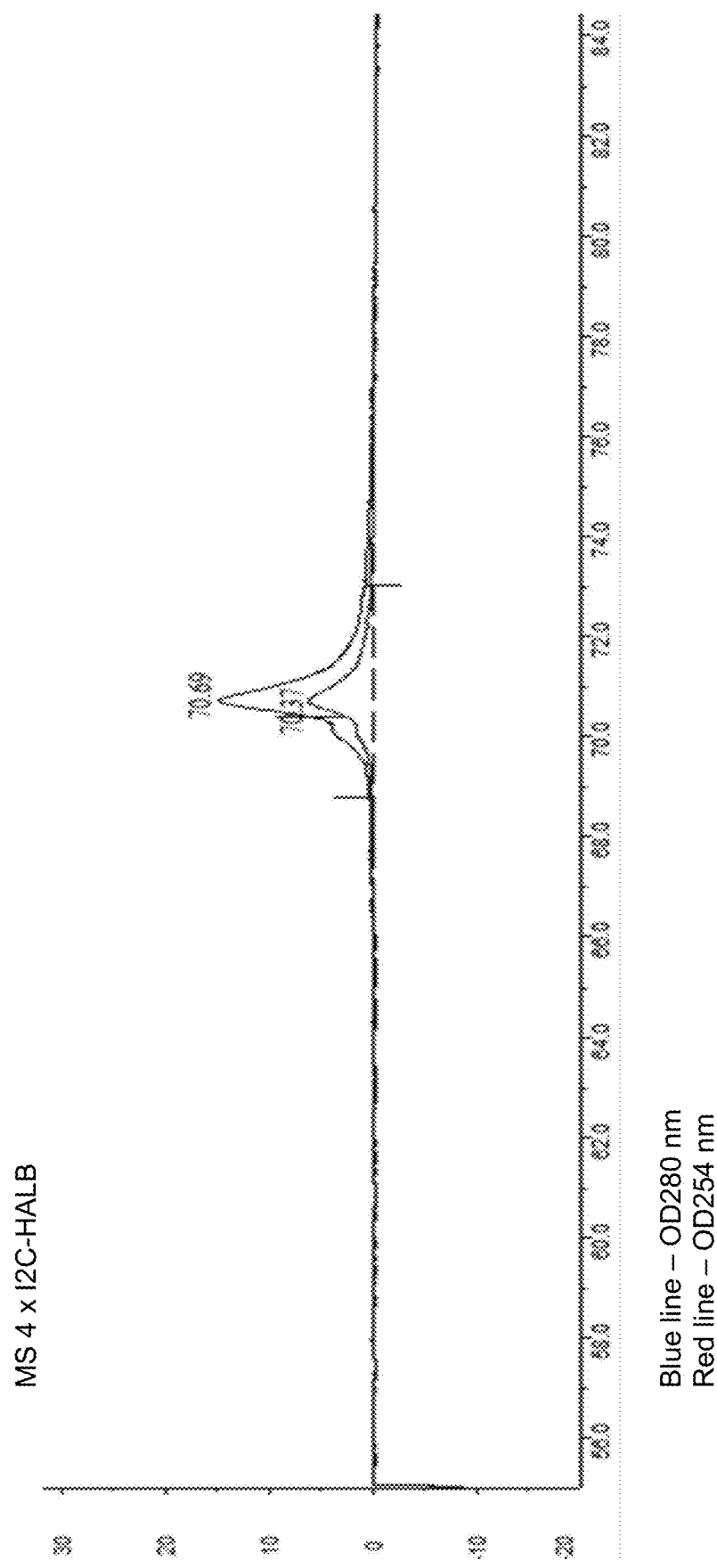

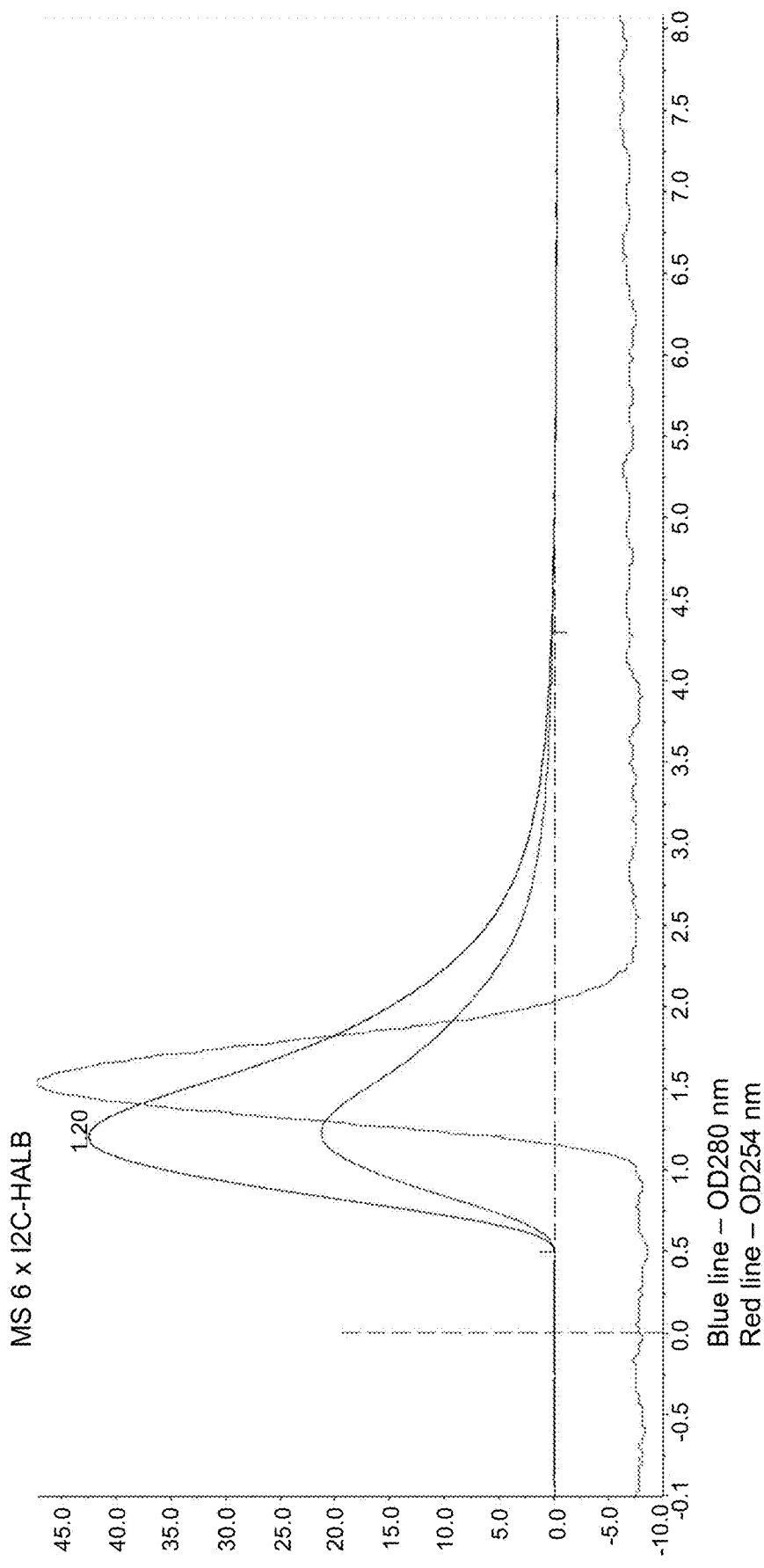

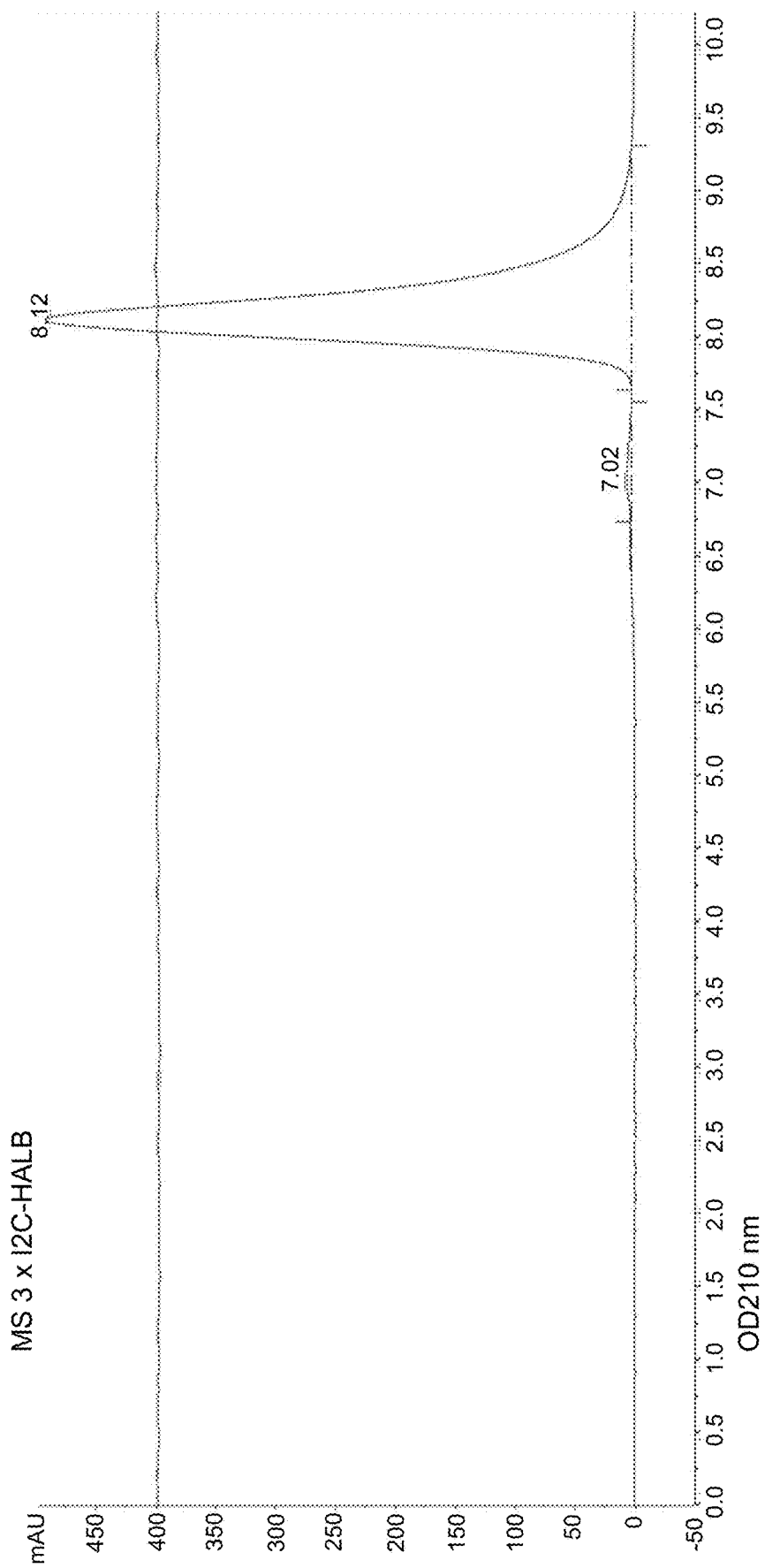

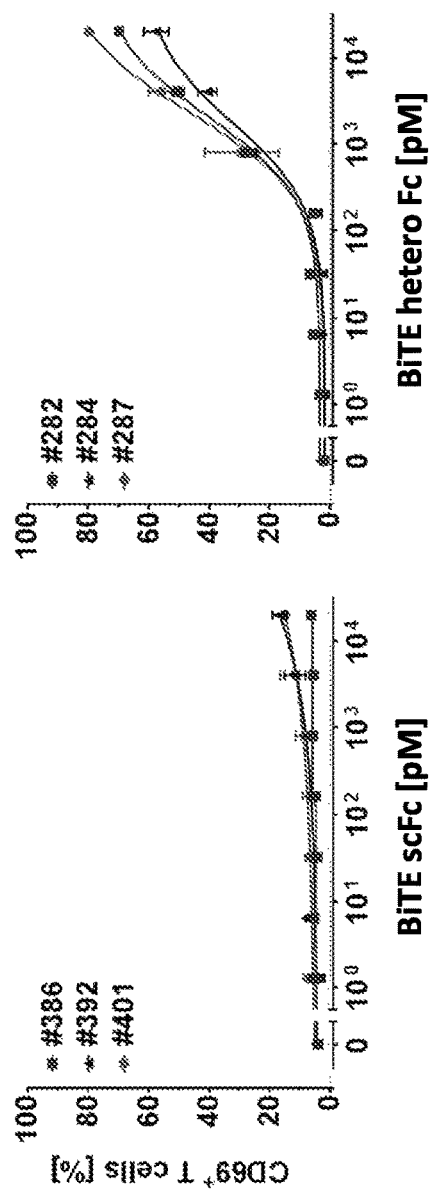
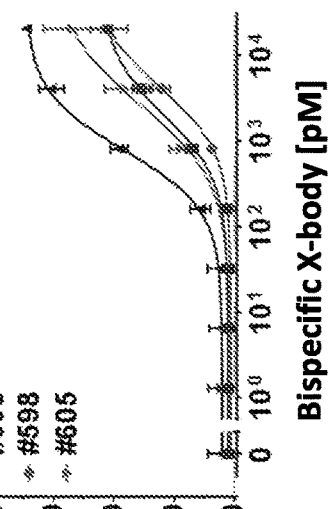
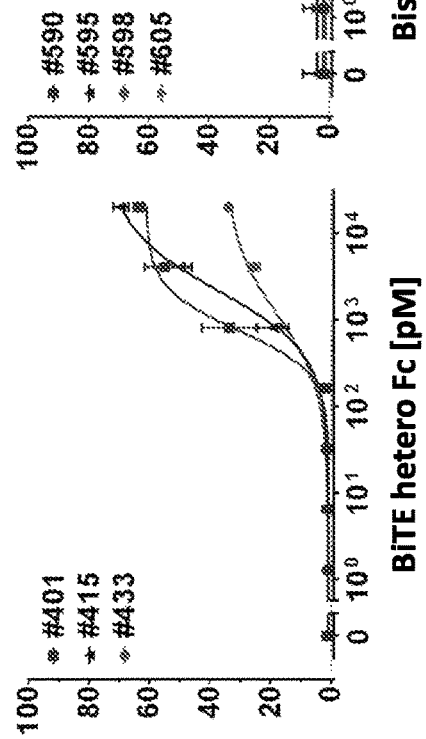
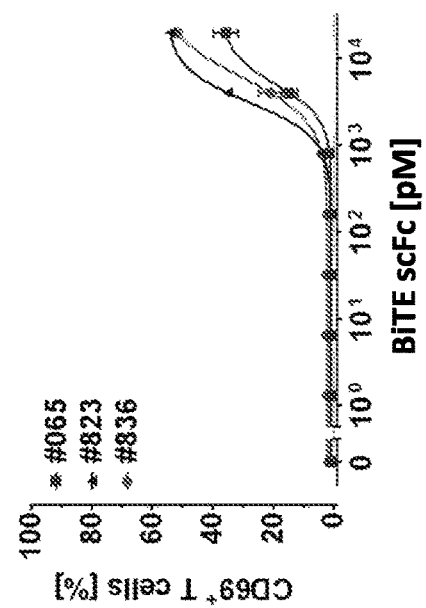

ANTIBODY CONSTRUCTS FOR MSLN AND CD3

INCORPORATION BY REFERENCE OF MATERIALS SUBMITTED ELECTRONICALLY

The Sequence Listing associated with this application is filed in electronic format via EFS-Web and hereby incorporated by reference into the specification in its entirety. The name of the text file containing the Sequence Listing is 49897A_SubSeqlisting. The size of the text file is 747,268 bytes, and the text file was created on Dec. 9, 2021.

The present invention relates to a bispecific antibody construct comprising a first binding domain which binds to human MSLN on the surface of a target cell and a second binding domain which binds to human CD3 on the surface of a T cell. Moreover, the invention provides a polynucleotide encoding the antibody construct, a vector comprising said polynucleotide and a host cell transformed or transfected with said polynucleotide or vector. Furthermore, the invention provides a process for the production of the antibody construct of the invention, a medical use of said antibody construct and a kit comprising said antibody construct.

INTRODUCTION

Mesothelin is a cell surface protein that was initially discovered as an antigen recognized by K1, a monoclonal antibody derived by immunization of mice with the OVCAR-3 human ovarian cancer cell line (Chang et al., Int. J. Cancer 1992). Expression cloning was used to identify the mesothelin cDNA from a HeLa library (Chang et al., PNAS 1996). Molecular analysis demonstrated that the mesothelin gene is encoded within a 69 kD precursor protein, which is cleaved by furin to give two distinct proteins: megakaryocyte potentiating factor (MPF), a 31 kD protein that is shed, and mesothelin, a 40 kD protein that associates with the cell membrane through a glycophosphatidylinositol linkage (GPI anchor) (Chang et al., PNAS 1996). The mesothelin protein is organized into superhelical domains, with ARM-type repeats.

Mesothelin is highly expressed in ovarian cancer as well as in other tumor types, including pancreatic cancer, mesothelioma, lung cancer, gastric cancer and triple negative breast cancer. In normal tissues, mesothelin is mainly expressed in the mesothelial cell layer of the pleural, pericardial, and peritoneal cavities. Mesothelin is also expressed on the surface epithelia of normal ovary, Fallopian tube and tonsil.

In addition to its expression on the cell surface, mesothelin is also shed into serum through the action of ADAM17/TACE. Serum levels of shed mesothelin are elevated in patients with ovarian cancer and other cancer. MESO-MARK®, an ELISA test for shed serum mesothelin (i.e., a quantitative measurement of Soluble Mesothelin-Related Peptides (SMRP), FUJIREBIO (Belgium)), is approved by the FDA for humanitarian use and may help in the diagnosis or monitoring of mesothelioma. Shed mesothelin has also been used, alone or together with other markers, to aid in diagnosis or prognosis of other cancer types.

The correlation of serum levels of shed mesothelin with disease suggested a potential role for the mesothelin protein in cancer progression. While the biological function of mesothelin is not well understood—knockout mice appear normal—mesothelin has been shown to bind the mucin MUC16/CA-125. The mesothelin-CA-125 interaction has been proposed to function in cell adhesion, invasion and metastasis.

The first antibodies generated against mesothelin for therapeutic intervention were designed to interfere with the interaction between mesothelin and CA-125. Phage display identified the Fv SS, which was affinity optimized and used to generate a recombinant immunotoxin targeting mesothelin, SS1P. The MORAb-009 antibody amatuximab, which also uses SS1, recognizes a non-linear epitope in the amino terminal 64 amino acids of mesothelin. The SS1 Fv was also used to generate chimeric antigen receptor-engineered T cells. Anti-mesothelin antibodies have also been used to generate drug conjugates, such as Anetumab ravtansine, containing the MF-T antibody coupled to DM4, and the 7D9 antibody conjugated to monomethyl auristatin E. These anti-mesothelin antibodies also recognize the amino terminal region of the protein (amino acids 296-390) although they do not compete with. These anti-mesothelin targeted therapeutics that are currently in clinical trials have shown limited efficacy as single agents.

Very recently, new anti-mesothelin antibodies have been reported that recognize other regions of the mesothelin protein. There still remains a need to understand whether antibodies against different epitopes of mesothelin than SS1/MORAb-009 (for example, antibodies that are not competed by shed mesothelin or shed CA-125) would have improved efficacy in patients.

As there is still a need for having available further options for the treatment of solid tumor diseases diseases related to the overexpression of MSLN, such as ovarian cancer, pancreatic cancer, mesothelioma, lung cancer, gastric cancer and triple negative breast cancer, there are provided herewith means and methods for the solution of this problem in the form of a bispecific antibody construct having a binding domain directed to MSLN on the surface of tumor target cells and a second binding domain directed to CD3 on the surface of T cells.

Thus, in a first aspect, the present invention provides a bispecific antibody construct comprising a first binding domain which binds to human MSLN on the surface of a target cell and a second binding domain which binds to human CD3 on the surface of a T cell, wherein the first binding domain binds to an epitope of MSLN which is comprised within the MSLN variants as depicted in SEQ ID NOs: 231, 232, and 233 and further binds to *Macaca fascicularis* MSLN as depicted in SEQ ID NOs: 234.

It must be noted that as used herein, the singular forms "a", "an", and "the" include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The term "antibody construct" refers to a molecule in which the structure and/or function is/are based on the structure and/or function of an antibody, e.g., of a full-length or whole immunoglobulin molecule. An antibody construct is hence capable of binding to its specific target or antigen. Furthermore, an antibody construct according to the invention comprises the minimum structural requirements of an antibody which allow for the target binding. This minimum requirement may e.g. be defined by the presence of at least the three light chain CDRs (i.e. CDR1, CDR2 and CDR3 of the VL region) and/or the three heavy chain CDRs (i.e. CDR1, CDR2 and CDR3 of the VH region), preferably of all six CDRs. The antibodies on which the constructs according to the invention are based include for example monoclonal, recombinant, chimeric, deimmunized, humanized and human antibodies.

Within the definition of "antibody constructs" according to the invention are full-length or whole antibodies also including camelid antibodies and other immunoglobulin antibodies generated by biotechnological or protein engineering methods or processes. These full-length antibodies may be for example monoclonal, recombinant, chimeric, deimmunized, humanized and human antibodies. Also within the definition of "antibody constructs" are fragments of full-length antibodies, such as VH, VHH, VL, (s)dAb, Fv, Fd, Fab, Fab', F(ab')2 or "r IgG" ("half antibody"). Antibody constructs according to the invention may also be modified fragments of antibodies, also called antibody variants, such as scFv, di-scFv or bi(s)-scFv, scFv-Fc, scFv-zipper, scFab, Fab2, Fab3, diabodies, single chain diabodies, tandem diabodies (Tandab's), tandem di-scFv, tandem tri-scFv, "minibodies" exemplified by a structure which is as follows: (VH-VL-CH3)2, (scFv-CH3)2, ((scFv)2-CH3+CH3), ((scFv)2-CH3) or (scFv-CH3-scFv)2, multibodies such as triabodies or tetrabodies, and single domain antibodies such as nanobodies or single variable domain antibodies comprising merely one variable domain, which might be VHH, VH or VL, that specifically bind an antigen or epitope independently of other V regions or domains.

A binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Additional examples for the format of antibody fragments, antibody variants or binding domains include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) an Fd fragment having the two VH and CH1 domains; (4) an Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv), the latter being preferred (for example, derived from an scFV-library). Examples for embodiments of antibody constructs according to the invention are e.g. described in WO 00/006605, WO 2005/040220, WO 2008/119567, WO 2010/037838, WO 2013/026837, WO 2013/026833, US 2014/0308285, US 2014/0302037, W O2014/144722, WO 2014/151910, and WO 2015/048272.

Furthermore, the definition of the term "antibody construct" includes monovalent, bivalent and polyvalent/multivalent constructs and, thus, monospecific constructs, specifically binding to only one antigenic structure, as well as bispecific and polyspecific/multispecific constructs, which specifically bind more than one antigenic structure, e.g. two, three or more, through distinct binding domains. Moreover, the definition of the term "antibody construct" includes molecules consisting of only one polypeptide chain as well as molecules consisting of more than one polypeptide chain, which chains can be either identical (homodimers, homotrimers or homo oligomers) or different (heterodimer, heterotrimer or heterooligomer). Examples for the above identified antibodies and variants or derivatives thereof are described inter alia in Harlow and Lane, Antibodies a laboratory manual, CSHL Press (1988) and Using Antibodies: a laboratory manual, CSHL Press (1999), Kontermann and Dübel, Antibody Engineering, Springer, 2nd ed. 2010 and Little, Recombinant Antibodies for Immunotherapy, Cambridge University Press 2009.

The antibody constructs of the present invention are preferably "in vitro generated antibody constructs". This term refers to an antibody construct according to the above definition where all or part of the variable region (e.g., at least one CDR) is generated in a non-immune cell selection, e.g., an in vitro phage display, protein chip or any other method in which candidate sequences can be tested for their ability to bind to an antigen. This term thus preferably excludes sequences generated solely by genomic rearrangement in an immune cell in an animal. A "recombinant antibody" is an antibody made through the use of recombinant DNA technology or genetic engineering.

The term "monoclonal antibody" (mAb) or monoclonal antibody construct as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site or determinant on the antigen, in contrast to conventional (polyclonal) antibody preparations which typically include different antibodies directed against different determinants (or epitopes). In addition to their specificity, the monoclonal antibodies are advantageous in that they are synthesized by the hybridoma culture, hence uncontaminated by other immunoglobulins. The modifier "monoclonal" indicates the character of the antibody as being obtained from a substantially homogeneous population of antibodies, and is not to be construed as requiring production of the antibody by any particular method.

For the preparation of monoclonal antibodies, any technique providing antibodies produced by continuous cell line cultures can be used. For example, monoclonal antibodies to be used may be made by the hybridoma method first described by Koehler et al., Nature, 256: 495 (1975), or may be made by recombinant DNA methods (see, e.g., U.S. Pat. No. 4,816,567). Examples for further techniques to produce human monoclonal antibodies include the trioma technique, the human B-cell hybridoma technique (Kozbor, Immunology Today 4 (1983), 72) and the EBV-hybridoma technique (Cole et al., Monoclonal Antibodies and Cancer Therapy, Alan R. Liss, Inc. (1985), 77-96).

Hybridomas can then be screened using standard methods, such as enzyme-linked immunosorbent assay (ELISA) and surface plasmon resonance (BIACORE™) analysis, to identify one or more hybridomas that produce an antibody that specifically binds with a specified antigen. Any form of the relevant antigen may be used as the immunogen, e.g., recombinant antigen, naturally occurring forms, any variants or fragments thereof, as well as an antigenic peptide thereof. Surface plasmon resonance as employed in the BIAcore system can be used to increase the efficiency of phage antibodies which bind to an epitope of a target antigen, such as MSLN or CD3 epsilon (Schier, Human Antibodies Hybridomas 7 (1996), 97-105; Malmborg, J. Immunol. Methods 183 (1995), 7-13).

Another exemplary method of making monoclonal antibodies includes screening protein expression libraries, e.g., phage display or ribosome display libraries. Phage display is described, for example, in Ladner et al., U.S. Pat. No. 5,223,409; Smith (1985) Science 228:1315-1317, Clackson et al., Nature, 352: 624-628 (1991) and Marks et al., J. Mol. Biol., 222: 581-597 (1991).

In addition to the use of display libraries, the relevant antigen can be used to immunize a non-human animal, e.g., a rodent (such as a mouse, hamster, rabbit or rat). In one embodiment, the non-human animal includes at least a part of a human immunoglobulin gene. For example, it is possible to engineer mouse strains deficient in mouse antibody production with large fragments of the human Ig (immunoglobulin) loci. Using the hybridoma technology, antigen-specific monoclonal antibodies derived from the genes with the desired specificity may be produced and selected. See, e.g., XENOMOUSE™, a transgenic mouse used to produce fully human antibodies, Green et al. (1994) Nature Genetics 7:13-21, US 2003-0070185, WO 96/34096, and WO 96/33735.

A monoclonal antibody can also be obtained from a non-human animal, and then modified, e.g., humanized, deimmunized, rendered chimeric etc., using recombinant DNA techniques known in the art. Examples of modified antibody constructs include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function(s) (see, e.g., U.S. Pat. No. 5,648,260, Kontermann and Dübel (2010), loc. cit. and Little (2009), loc. cit.).

In immunology, affinity maturation is the process by which B cells produce antibodies with increased affinity for antigen during the course of an immune response. With repeated exposures to the same antigen, a host will produce antibodies of successively greater affinities. Like the natural prototype, the in vitro affinity maturation is based on the principles of mutation and selection. The in vitro affinity maturation has successfully been used to optimize antibodies, antibody constructs, and antibody fragments. Random mutations inside the CDRs are introduced using radiation, chemical mutagens or error-prone PCR. In addition, the genetical diversity can be increased by chain shuffling. Two or three rounds of mutation and selection using display methods like phage display usually results in antibody fragments with affinities in the low nanomolar range.

A preferred type of an amino acid substitutional varianation of the antibody constructs involves substituting one or more hypervariable region residues of a parent antibody (e.g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human MSLN. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

The monoclonal antibodies and antibody constructs of the present invention specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is/are identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81: 6851-6855 (1984)). Chimeric antibodies of interest herein include "primitized" antibodies comprising variable domain antigen-binding sequences derived from a non-human primate (e.g., Old World Monkey, Ape etc.) and human constant region sequences. A variety of approaches for making chimeric antibodies have been described. See e.g., Morrison et al., Proc. Natl. Acad. ScL U.S.A. 81:6851, 1985; Takeda et al., Nature 314:452, 1985, Cabilly et al., U.S. Pat. No. 4,816,567; Boss et al., U.S. Pat. No. 4,816,397; Tanaguchi et al., EP 0171496; EP 0173494; and GB 2177096.

An antibody, antibody construct, antibody fragment or antibody variant may also be modified by specific deletion of human T cell epitopes (a method called "deimmunization") by the methods disclosed for example in WO 98/52976 or WO 00/34317. Briefly, the heavy and light chain variable domains of an antibody can be analyzed for peptides that bind to MHC class II; these peptides represent potential T cell epitopes (as defined in WO 98/52976 and WO 00/34317). For detection of potential T cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T cell epitopes detected can be eliminated by substituting small numbers of amino acid residues in the variable domains, or preferably, by single amino acid substitutions. Typically, conservative substitutions are made. Often, but not exclusively, an amino acid common to a position in human germline antibody sequences may be used. Human germline sequences are disclosed e.g. in Tomlinson, et al. (1992) J. Mol. Biol. 227:776-798; Cook, G. P. et al. (1995) Immunol. Today Vol. 16(5): 237-242; and Tomlinson et al. (1995) EMBO J. 14: 14:4628-4638. The V BASE directory provides a comprehensive directory of human immunoglobulin variable region sequences (compiled by Tomlinson, I A. et al. MRC Centre for Protein Engineering, Cambridge, UK). These sequences can be used as a source of human sequence, e.g., for framework regions and CDRs. Consensus human framework regions can also be used, for example as described in U.S. Pat. No. 6,300,064.

"Humanized" antibodies, antibody constructs, variants or fragments thereof (such as Fv, Fab, Fab', F(ab')2 or other antigen-binding subsequences of antibodies) are antibodies or immunoglobulins of mostly human sequences, which contain (a) minimal sequence(s) derived from non-human immunoglobulin. For the most part, humanized antibodies are human immunoglobulins (recipient antibody) in which residues from a hypervariable region (also CDR) of the recipient are replaced by residues from a hypervariable region of a non-human (e.g., rodent) species (donor antibody) such as mouse, rat, hamster or rabbit having the desired specificity, affinity, and capacity. In some instances, Fv framework region (FR) residues of the human immunoglobulin are replaced by corresponding non-human residues. Furthermore, "humanized antibodies" as used herein may also comprise residues which are found neither in the recipient antibody nor the donor antibody. These modifications are made to further refine and optimize antibody performance. The humanized antibody may also comprise at least a portion of an immunoglobulin constant region (Fc), typically that of a human immunoglobulin. For further details, see Jones et al., Nature, 321: 522-525 (1986); Reichmann et al., Nature, 332: 323-329 (1988); and Presta, Curr. Op. Struct. Biol., 2: 593-596 (1992).

Humanized antibodies or fragments thereof can be generated by replacing sequences of the Fv variable domain that are not directly involved in antigen binding with equivalent sequences from human Fv variable domains. Exemplary methods for generating humanized antibodies or fragments thereof are provided by Morrison (1985) Science 229:1202-1207; by Oi et al. (1986) BioTechniques 4:214; and by U.S. Pat. Nos. 5,585,089; 5,693,761; 5,693,762; 5,859,205; and 6,407,213. Those methods include isolating, manipulating, and expressing the nucleic acid sequences that encode all or part of immunoglobulin Fv variable domains from at least one of a heavy or light chain. Such nucleic acids may be obtained from a hybridoma producing an antibody against a predetermined target, as described above, as well as from other sources. The recombinant DNA encoding the humanized antibody molecule can then be cloned into an appropriate expression vector.

Humanized antibodies may also be produced using transgenic animals such as mice that express human heavy and light chain genes, but are incapable of expressing the endogenous mouse immunoglobulin heavy and light chain genes. Winter describes an exemplary CDR grafting method that may be used to prepare the humanized antibodies described herein (U.S. Pat. No. 5,225,539). All of the CDRs of a particular human antibody may be replaced with at least a portion of a non-human CDR, or only some of the CDRs may be replaced with non-human CDRs. It is only necessary to replace the number of CDRs required for binding of the humanized antibody to a predetermined antigen.

A humanized antibody can be optimized by the introduction of conservative substitutions, consensus sequence substitutions, germline substitutions and/or back mutations. Such altered immunoglobulin molecules can be made by any of several techniques known in the art, (e.g., Teng et al., Proc. Natl. Acad. Sci. U.S.A., 80: 7308-7312, 1983; Kozbor et al., Immunology Today, 4: 7279, 1983; Olsson et al., Meth. Enzymol., 92: 3-16, 1982, and EP 239 400).

The term "human antibody", "human antibody construct" and "human binding domain" includes antibodies, antibody constructs and binding domains having antibody regions such as variable and constant regions or domains which correspond substantially to human germline immunoglobulin sequences known in the art, including, for example, those described by Kabat et al. (1991) (loc. cit.). The human antibodies, antibody constructs or binding domains of the invention may include amino acid residues not encoded by human germline immunoglobulin sequences (e.g., mutations introduced by random or site-specific mutagenesis in vitro or by somatic mutation in vivo), for example in the CDRs, and in particular, in CDR3. The human antibodies, antibody constructs or binding domains can have at least one, two, three, four, five, or more positions replaced with an amino acid residue that is not encoded by the human germline immunoglobulin sequence. The definition of human antibodies, antibody constructs and binding domains as used herein also contemplates fully human antibodies, which include only non-artificially and/or genetically altered human sequences of antibodies as those can be derived by using technologies or systems such as the Xenomouse.

In some embodiments, the antibody constructs of the invention are "isolated" or "substantially pure" antibody constructs. "Isolated" or "substantially pure", when used to describe the antibody constructs disclosed herein, means an antibody construct that has been identified, separated and/or recovered from a component of its production environment. Preferably, the antibody construct is free or substantially free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. The antibody constructs may e.g constitute at least about 5%, or at least about 50% by weight of the total protein in a given sample. It is understood that the isolated protein may constitute from 5% to 99.9% by weight of the total protein content, depending on the circumstances. The polypeptide may be made at a significantly higher concentration through the use of an inducible promoter or high expression promoter, such that it is made at increased concentration levels. The definition includes the production of an antibody construct in a wide variety of organisms and/or host cells that are known in the art. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody construct will be prepared by at least one purification step.

The term "binding domain" characterizes in connection with the present invention a domain which (specifically) binds to/interacts with/recognizes a given target epitope or a given target site on the target molecules (antigens), here: MSLN and CD3, respectively. The structure and function of the first binding domain (recognizing MSLN), and preferably also the structure and/or function of the second binding domain (recognizing CD3), is/are based on the structure and/or function of an antibody, e.g. of a full-length or whole immunoglobulin molecule. According to the invention, the first binding domain is characterized by the presence of three light chain CDRs (i.e. CDR1, CDR2 and CDR3 of the VL region) and/or three heavy chain CDRs (i.e. CDR1, CDR2 and CDR3 of the VH region). The second binding domain preferably also comprises the minimum structural requirements of an antibody which allow for the target binding. More preferably, the second binding domain comprises at least three light chain CDRs (i.e. CDR1, CDR2 and CDR3 of the VL region) and/or three heavy chain CDRs (i.e. CDR1, CDR2 and CDR3 of the VH region). It is envisaged that the first and/or second binding domain is produced by or obtainable by phage-display or library screening methods rather than by grafting CDR sequences from a pre-existing (monoclonal) antibody into a scaffold.

According to the present invention, binding domains are in the form of one or more polypeptides. Such polypeptides may include proteinaceous parts and non-proteinaceous parts (e.g. chemical linkers or chemical cross-linking agents such as glutaraldehyde). Proteins (including fragments thereof, preferably biologically active fragments, and peptides, usually having less than 30 amino acids) comprise two or more amino acids coupled to each other via a covalent peptide bond (resulting in a chain of amino acids). The term "polypeptide" as used herein describes a group of molecules, which usually consist of more than 30 amino acids. Polypeptides may further form multimers such as dimers, trimers and higher oligomers, i.e., consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "peptide", "polypeptide" and "protein" also refer to naturally modified peptides/polypeptides/proteins wherein the modification is effected e.g. by post-translational modifications like glycosylation, acetylation, phosphorylation and the like. A "peptide", "polypeptide" or "protein" when referred to herein may also be chemically modified such as pegylated. Such modifications are well known in the art and described herein below.

Preferably the binding domain which binds to MSLN and/or the binding domain which binds to CD3 is/are human binding domains. Antibodies and antibody constructs comprising at least one human binding domain avoid some of the problems associated with antibodies or antibody constructs that possess non-human such as rodent (e.g. murine, rat, hamster or rabbit) variable and/or constant regions. The presence of such rodent derived proteins can lead to the rapid clearance of the antibodies or antibody constructs or can lead to the generation of an immune response against the antibody or antibody construct by a patient. In order to avoid the use of rodent derived antibodies or antibody constructs, human or fully human antibodies/antibody constructs can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the use of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies or antibody constructs are expected to minimize the immunogenic and allergic responses intrinsic to mouse or mouse-derivatized mAbs and thus to increase the efficacy and safety of the administered antibodies/antibody constructs. The use of fully human antibodies or antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with the generation of the first XENOMOUSE™ mouse strains (see Green et al. Nature Genetics 7:13-21 (1994)). The XENOMOUSE™ strains were engineered with yeast artificial chromosomes (YACs) containing 245 kb and 190 kb-sized germline configuration fragments of the human heavy chain locus and kappa light chain locus, respectively, which contained core variable and constant region sequences. The human Ig containing YACs proved to be compatible with the mouse system for both rearrangement and expression of antibodies and were capable of substituting for the inactivated mouse Ig genes. This was demonstrated by their ability to induce B cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620.

The production of the XenoMouse mice is further discussed and delineated in U.S. patent application Ser. No. 07/466,008, Ser. No. 07/610,515, Ser. No. 07/919,297, Ser. No. 07/922,649, Ser. No. 08/031,801, Ser. No. 08/112,848, Ser. No. 08/234,145, Ser. No. 08/376,279, Ser. No. 08/430, 938, Ser. No. 08/464,584, Ser. No. 08/464,582, Ser. No. 08/463,191, Ser. No. 08/462,837, Ser. No. 08/486,853, Ser. No. 08/486,857, Ser. No. 08/486,859, Ser. No. 08/462,513, Ser. No. 08/724,752, and Ser. No. 08/759,620; and U.S. Pat. Nos. 6,162,963; 6,150,584; 6,114,598; 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998), EP 0 463 151 B1, WO 94/02602, WO 96/34096, WO 98/24893, WO 00/76310, and WO 03/47336.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more VH genes, one or more DH genes, one or more JH genes, a mu constant region, and a second constant region (preferably a gamma constant region) are formed into a construct for insertion into an animal. This approach is described in U.S. Pat. No. 5,545, 807 to Surani et al. and U.S. Pat. Nos. 5,545,806; 5,625,825; 5,625,126; 5,633,425; 5,661,016; 5,770,429; 5,789,650; 5,814,318; 5,877,397; 5,874,299; and 6,255,458 each to Lonberg and Kay, U.S. Pat. Nos. 5,591,669 and 6,023,010 to Krimpenfort and Berns, U.S. Pat. Nos. 5,612,205; 5,721; 367; and 5,789,215 to Berns et al., and U.S. Pat. No. 5,643,763 to Choi and Dunn, and GenPharm International U.S. patent application Ser. No. 07/574,748, Ser. No. 07/575,962, Ser. No. 07/810,279, Ser. No. 07/853,408, Ser. No. 07/904,068, Ser. No. 07/990,860, Ser. No. 08/053,131, Ser. No. 08/096,762, Ser. No. 08/155,301, Ser. No. 08/161, 739, Ser. No. 08/165,699, Ser. No. 08/209,741. See also EP 0 546 073 B1, WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175. See further Taylor et al. (1992), Chen et al. (1993), Tuaillon et al. (1993), Choi et al. (1993), Lonberg et al. (1994), Taylor et al. (1994), and Tuaillon et al. (1995), Fishwild et al. (1996).

Kirin has also demonstrated the generation of human antibodies from mice in which, through microcell fusion, large pieces of chromosomes, or entire chromosomes, have been introduced. See European Patent Application Nos. 773 288 and 843 961. Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996; 5,698,767; and 5,958,765.

Human anti-mouse antibody (HAMA) responses have led the industry to prepare chimeric or otherwise humanized antibodies. It is however expected that certain human anti-chimeric antibody (HACA) responses will be observed, particularly in chronic or multi-dose utilizations of the antibody. Thus, it would be desirable to provide antibody constructs comprising a human binding domain against MSLN and a human binding domain against CD3 in order to vitiate concerns and/or effects of HAMA or HACA response.

The terms "(specifically) binds to", (specifically) recognizes", "is (specifically) directed to", and "(specifically) reacts with" mean in accordance with this invention that a binding domain interacts or specifically interacts with a given epitope or a given target site on the target molecules (antigens), here: MSLN and CD3, respectively.

The term "epitope" refers to a site on an antigen to which a binding domain, such as an antibody or immunoglobulin, or a derivative, fragment or variant of an antibody or an immunoglobulin, specifically binds. An "epitope" is antigenic and thus the term epitope is sometimes also referred to herein as "antigenic structure" or "antigenic determinant". Thus, the binding domain is an "antigen interaction site". Said binding/interaction is also understood to define a "specific recognition".

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigenic structure for one of the binding domains is comprised within the MSLN protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy.

A method for epitope mapping is described in the following: When a region (a contiguous amino acid stretch) in the human MSLN protein is exchanged/replaced with its corresponding region of a non-human and non-primate MSLN antigen (e.g., mouse MSLN, but others like chicken, rat, hamster, rabbit etc. might also be conceivable), a decrease in the binding of the binding domain is expected to occur, unless the binding domain is cross-reactive for the non-human, non-primate MSLN used. Said decrease is preferably at least 10%, 20%, 30%, 40%, or 50%; more preferably at least 60%, 70%, or 80%, and most preferably 90%, 95% or even 100% in comparison to the binding to the respective region in the human MSLN protein, whereby binding to the respective region in the human MSLN protein is set to be 100%. It is envisaged that the aforementioned human MSLN/non-human MSLN chimeras are expressed in CHO cells. The human MSLN/non-human MSLN chimeras may also be fused with a transmembrane domain and/or cytoplasmic domain of a different membrane-bound protein such as EpCAM, although such technique was not necessary for the method described in Examples 1 and 2.

In an alternative or additional method for epitope mapping, several truncated versions of the human MSLN extracellular domain can be generated in order to determine a specific region that is recognized by a binding domain. In these truncated versions, the different extracellular MSLN domains/sub-domains or regions are stepwise deleted, starting from the N-terminus. The truncated MSLN versions that may be expressed in CHO cells. It is also envisaged that the truncated MSLN versions may be fused with a transmembrane domain and/or cytoplasmic domain of a different membrane-bound protein such as EpCAM. It is also envisaged that the truncated MSLN versions may encompass a signal peptide domain at their N-terminus, for example a signal peptide derived from mouse IgG heavy chain signal peptide. It is furthermore envisaged that the truncated MSLN versions may encompass a v5 domain at their N-terminus (following the signal peptide) which allows verifying their correct expression on the cell surface. A decrease or a loss of binding is expected to occur with those truncated MSLN versions which do not encompass any more the MSLN region that is recognized by the binding domain. The decrease of binding is preferably at least 10%, 20%, 30%, 40%, 50%; more preferably at least 60%, 70%, 80%, and most preferably 90%, 95% or even 100%, whereby binding to the entire human MSLN protein (or its extracellular region or domain) is set to be 100%.

A further method to determine the contribution of a specific residue of a target antigen to the recognition by a antibody construct or binding domain is alanine scanning (see e.g. Morrison K L & Weiss G A. Cur Opin Chem Biol. 2001 June; 5(3):302-7), where each residue to be analyzed is replaced by alanine, e.g. via site-directed mutagenesis. Alanine is used because of its non-bulky, chemically inert, methyl functional group that nevertheless mimics the secondary structure references that many of the other amino acids possess. Sometimes bulky amino acids such as valine or leucine can be used in cases where conservation of the size of mutated residues is desired. Alanine scanning is a mature technology which has been used for a long period of time.

The interaction between the binding domain and the epitope or the region comprising the epitope implies that a binding domain exhibits appreciable affinity for the epitope/ the region comprising the epitope on a particular protein or antigen (here: MSLN and CD3, respectively) and, generally, does not exhibit significant reactivity with proteins or antigens other than MSLN or CD3. "Appreciable affinity" includes binding with an affinity of about $10^{-8}$ M (KD) or stronger. Preferably, binding is considered specific when the binding affinity is about $10^{-12}$ to $10^{-8}$ M, $10^{-12}$ to $10^{-9}$ M, $10^{-12}$ to $10^{-19}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than MSLN or CD3. Preferably, a binding domain of the invention does not essentially or substantially bind to proteins or antigens other than MSLN or CD3 (i.e., the first binding domain is not capable of binding to proteins other than MSLN and the second binding domain is not capable of binding to proteins other than CD3).

The term "does not essentially/substantially bind" or "is not capable of binding" means that a binding domain of the present invention does not bind a protein or antigen other than MSLN or CD3, i.e., does not show reactivity of more than 30%, preferably not more than 20%, more preferably not more than 10%, particularly preferably not more than 9%, 8%, 7%, 6% or 5% with proteins or antigens other than MSLN or CD3, whereby binding to MSLN or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

It is also preferred in one embodiment of the invention that the second binding domain binds to human CD3 epsilon and to *Callithrix jacchus, Saguinus Oedipus* or *Saimiri sciureus* CD3 epsilon.

In another aspect, the present invention provides a bispecific antibody construct comprising a first binding domain which binds to human MSLN on the surface of a target cell and a second binding domain which binds to human CD3 on the surface of a T cell, wherein the first binding domain binds to an epitope of MSLN which is comprised within the region of the human MSLN having a sequence as depicted in SEQ ID NO selected form the group consisting of SEQ ID NO: 244 (cluster 1+2), SEQ ID NO: 245 (cluster 2+3) and SEQ ID NO: 241 (cluster 4).

Preferably, the first binding domain of the bispecific antibody construct of the invention comprises a VH region comprising CDR-H1, CDR-H2 and CDR-H3 and a VL region comprising CDR-L1, CDR-L2 and CDR-L3 selected from the group consisting of:
 a) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156;
 b) CDR-H1 as depicted in SEQ ID NO: 161, CDR-H2 as depicted in SEQ ID NO: 162, CDR-H3 as depicted in SEQ ID NO: 163, CDR-L1 as depicted in SEQ ID NO: 164, CDR-L2 as depicted in SEQ ID NO: 165 and CDR-L3 as depicted in SEQ ID NO: 166;
 c) CDR-H1 as depicted in SEQ ID NO: 171, CDR-H2 as depicted in SEQ ID NO: 172, CDR-H3 as depicted in SEQ ID NO: 173, CDR-L1 as depicted in SEQ ID NO: 174, CDR-L2 as depicted in SEQ ID NO: 175 and CDR-L3 as depicted in SEQ ID NO: 176;
 d) CDR-H1 as depicted in SEQ ID NO: 181, CDR-H2 as depicted in SEQ ID NO: 182, CDR-H3 as depicted in SEQ ID NO: 183, CDR-L1 as depicted in SEQ ID NO:

184, CDR-L2 as depicted in SEQ ID NO: 185 and CDR-L3 as depicted in SEQ ID NO: 186;

e) CDR-H1 as depicted in SEQ ID NO: 191, CDR-H2 as depicted in SEQ ID NO: 192, CDR-H3 as depicted in SEQ ID NO: 193, CDR-L1 as depicted in SEQ ID NO: 194, CDR-L2 as depicted in SEQ ID NO: 195 and CDR-L3 as depicted in SEQ ID NO: 196;

f) CDR-H1 as depicted in SEQ ID NO: 201, CDR-H2 as depicted in SEQ ID NO: 202, CDR-H3 as depicted in SEQ ID NO: 203, CDR-L1 as depicted in SEQ ID NO: 204, CDR-L2 as depicted in SEQ ID NO: 205 and CDR-L3 as depicted in SEQ ID NO: 206;

g) CDR-H1 as depicted in SEQ ID NO: 211, CDR-H2 as depicted in SEQ ID NO: 212, CDR-H3 as depicted in SEQ ID NO: 213, CDR-L1 as depicted in SEQ ID NO: 214, CDR-L2 as depicted in SEQ ID NO: 215 and CDR-L3 as depicted in SEQ ID NO: 216; and h) CDR-H1 as depicted in SEQ ID NO: 221, CDR-H2 as depicted in SEQ ID NO: 222, CDR-H3 as depicted in SEQ ID NO: 223, CDR-L1 as depicted in SEQ ID NO: 224, CDR-L2 as depicted in SEQ ID NO: 225 and CDR-L3 as depicted in SEQ ID NO: 226.

The term "variable" refers to the portions of the antibody or immunoglobulin domains that exhibit variability in their sequence and that are involved in determining the specificity and binding affinity of a particular antibody (i.e., the "variable domain(s)"). The pairing of a variable heavy chain (VH) and a variable light chain (VL) together forms a single antigen-binding site.

Variability is not evenly distributed throughout the variable domains of antibodies; it is concentrated in sub-domains of each of the heavy and light chain variable regions. These sub-domains are called "hypervariable regions" or "complementarity determining regions" (CDRs). The more conserved (i.e., non-hypervariable) portions of the variable domains are called the "framework" regions (FRM or FR) and provide a scaffold for the six CDRs in three dimensional space to form an antigen-binding surface. The variable domains of naturally occurring heavy and light chains each comprise four FRM regions (FR1, FR2, FR3, and FR4), largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.).

The terms "CDR", and its plural "CDRs", refer to the complementarity determining region of which three make up the binding character of a light chain variable region (CDR-L1, CDR-L2 and CDR-L3) and three make up the binding character of a heavy chain variable region (CDR-H1, CDR-H2 and CDR-H3). CDRs contain most of the residues responsible for specific interactions of the antibody with the antigen and hence contribute to the functional activity of an antibody molecule: they are the main determinants of antigen specificity.

The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat (an approach based on cross-species sequence variability), Chothia (an approach based on crystallographic studies of antigen-antibody complexes), and/or MacCallum (Kabat et al., loc. cit.; Chothia et al., J. Mol. Biol, 1987, 196: 901-917; and MacCallum et al., J. Mol. Biol, 1996, 262: 732). Still another standard for characterizing the antigen binding site is the AbM definition used by Oxford Molecular's AbM antibody modeling software. See, e.g., Protein Sequence and Structure Analysis of Antibody Variable Domains. In: Antibody Engineering Lab Manual (Ed.: Duebel, S. and Kontermann, R., Springer-Verlag, Heidelberg). To the extent that two residue identification techniques define regions of overlapping, but not identical regions, they can be combined to define a hybrid CDR. However, the numbering in accordance with the so-called Kabat system is preferred.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196:901; Chothia et al., Nature, 1989, 342: 877; Martin and Thornton, J. Mol. Biol, 1996, 263: 800). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues.

The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al. and/or revealed by other techniques, for example, crystallography and two- or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988.

The CDR3 of the light chain and, particularly, the CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen. Hence, CDR3 is typically the greatest source of molecular diversity within the antibody-binding site. H3, for example, can be as short as two amino acid residues or greater than 26 amino acids.

In a classical full-length antibody or immunoglobulin, each light (L) chain is linked to a heavy (H) chain by one covalent disulfide bond, while the two H chains are linked to each other by one or more disulfide bonds depending on the H chain isotype. The CH domain most proximal to VH is usually designated as CH1. The constant ("C") domains are not directly involved in antigen binding, but exhibit various effector functions, such as antibody-dependent, cell-mediated cytotoxicity and complement activation. The Fc region of an antibody is comprised within the heavy chain constant domains and is for example able to interact with cell surface located Fc receptors.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, CA, 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

A preferred antibody construct according to the invention can also be defined as a bispecific antibody construct comprising a first (preferably human) binding domain which binds to human MSLN on the surface of a target cell and a second binding domain which binds to human CD3 on the surface of a T cell, wherein the first binding domain binds to the same epitope of MSLN as an antibody selected from the group consisting of MS_1 to MS_8, i.e., an antibody comprising a VH region comprising CDR-H1, CDR-H2 and CDR-H3 and a VL region comprising CDR-L1, CDR-L2 and CDR-L3 selected from the group consisting of:

a) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156;

b) CDR-H1 as depicted in SEQ ID NO: 161, CDR-H2 as depicted in SEQ ID NO: 162, CDR-H3 as depicted in SEQ ID NO: 163, CDR-L1 as depicted in SEQ ID NO: 164, CDR-L2 as depicted in SEQ ID NO: 165 and CDR-L3 as depicted in SEQ ID NO: 166;

c) CDR-H1 as depicted in SEQ ID NO: 171, CDR-H2 as depicted in SEQ ID NO: 172, CDR-H3 as depicted in SEQ ID NO: 173, CDR-L1 as depicted in SEQ ID NO: 174, CDR-L2 as depicted in SEQ ID NO: 175 and CDR-L3 as depicted in SEQ ID NO: 176;

d) CDR-H1 as depicted in SEQ ID NO: 181, CDR-H2 as depicted in SEQ ID NO: 182, CDR-H3 as depicted in SEQ ID NO: 183, CDR-L1 as depicted in SEQ ID NO: 184, CDR-L2 as depicted in SEQ ID NO: 185 and CDR-L3 as depicted in SEQ ID NO: 186;

e) CDR-H1 as depicted in SEQ ID NO: 191, CDR-H2 as depicted in SEQ ID NO: 192, CDR-H3 as depicted in SEQ ID NO: 193, CDR-L1 as depicted in SEQ ID NO: 194, CDR-L2 as depicted in SEQ ID NO: 195 and CDR-L3 as depicted in SEQ ID NO: 196;

f) CDR-H1 as depicted in SEQ ID NO: 201, CDR-H2 as depicted in SEQ ID NO: 202, CDR-H3 as depicted in SEQ ID NO: 203, CDR-L1 as depicted in SEQ ID NO: 204, CDR-L2 as depicted in SEQ ID NO: 205 and CDR-L3 as depicted in SEQ ID NO: 206;

g) CDR-H1 as depicted in SEQ ID NO: 211, CDR-H2 as depicted in SEQ ID NO: 212, CDR-H3 as depicted in SEQ ID NO: 213, CDR-L1 as depicted in SEQ ID NO: 214, CDR-L2 as depicted in SEQ ID NO: 215 and CDR-L3 as depicted in SEQ ID NO: 216; and h) CDR-H1 as depicted in SEQ ID NO: 221, CDR-H2 as depicted in SEQ ID NO: 222, CDR-H3 as depicted in SEQ ID NO: 223, CDR-L1 as depicted in SEQ ID NO: 224, CDR-L2 as depicted in SEQ ID NO: 225 and CDR-L3 as depicted in SEQ ID NO: 226.

Whether or not an antibody construct binds to the same epitope of MSLN as another given antibody construct can be measured e.g. by epitope mapping with chimeric or truncated target molecules, e.g. as described herein above and in in the appended Examples 1 and 2.

A preferred antibody construct according to the invention can also be defined as a bispecific antibody construct comprising a first (preferably human) binding domain which binds to human MSLN on the surface of a target cell and a second binding domain which binds to human CD3 on the surface of a T cell, wherein the first binding domain competes for binding with an antibody selected from the group consisting of MS_1 to MS_8, i.e., an antibody comprising a VH region comprising CDR-H1, CDR-H2 and CDR-H3 and a VL region comprising CDR-L1, CDR-L2 and CDR-L3 selected from the group consisting of those described above.

Whether or not an antibody construct competes for binding with another given antibody construct can be measured in a competition assay such as a competitive ELISA or a cell-based competition assay. Avidin-coupled microparticles (beads) can also be used. Similar to an avidin-coated ELISA plate, when reacted with a biotinylated protein, each of these beads can be used as a substrate on which an assay can be performed. Antigen is coated onto a bead and then precoated with the first antibody. The second antibody is added and any additional binding is determined. Possible means for the read-out includes flow cytometry.

In one embodiment, the first binding domain of the antibody construct of the invention comprises a VH region selected from the group consisting of those depicted in SEQ ID NO: 157, SEQ ID NO: 167, SEQ ID NO: 177, SEQ ID NO: 187, SEQ ID NO: 197, SEQ ID NO: 207, SEQ ID NO: 217, and SEQ ID NO: 227.

In a further embodiment, the first binding domain of the antibody construct of the invention comprises a VL region selected from the group consisting of those depicted in SEQ ID NO: 158, SEQ ID NO: 168, SEQ ID NO: 178, SEQ ID NO: 188, SEQ ID NO: 198, SEQ ID NO: 208, SEQ ID NO: 218, and SEQ ID NO: 228.

In another embodiment, the first binding domain of the antibody construct of the invention comprises a VH region and a VL region selected from the group consisting of pairs of a VH region and a VL region as depicted in SEQ ID NO: 157+158, SEQ ID NO: 167+168, SEQ ID NO: 177+178, SEQ ID NO: 187+188, SEQ ID NO: 197+198, SEQ ID NO: 207+208, SEQ ID NO: 217+218, and SEQ ID NO: 227+228.

In yet a further embodiment, the first binding domain of the antibody construct of the invention comprises a polypeptide selected from the group consisting of those depicted in SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229.

The above first binding domains (which are specified by their CDRs, VH region and VL region and combinations thereof) characterize as binding domains which bind to an epitope of MSLN as depicted in SEQ ID NOs: 231, 232, and 233.

The term "bispecific" as used herein refers to an antibody construct which is "at least bispecific", i.e., it comprises at least a first binding domain and a second binding domain, wherein the first binding domain binds to one antigen or target (here: MSLN), and the second binding domain binds to another antigen or target (here: CD3). Accordingly, antibody constructs according to the invention comprise specificities for at least two different antigens or targets. The term "bispecific antibody construct" of the invention also encompasses multispecific antibody constructs such as trispecific antibody constructs, the latter ones including three binding domains, or constructs having more than three (e.g. four, five . . . ) specificities.

Given that the antibody constructs according to the invention are (at least) bispecific, they do not occur naturally and they are markedly different from naturally occurring products. A "bispecific" antibody construct or immunoglobulin is hence an artificial hybrid antibody or immunoglobulin having at least two distinct binding sites with different specificities. Bispecific antibody constructs can be produced by a variety of methods including fusion of hybridomas or linking of Fab' fragments. See, e.g., Songsivilai & Lachmann, Olin. Exp. Immunol. 79:315-321 (1990).

The at least two binding domains and the variable domains of the antibody construct of the present invention may or may not comprise peptide linkers (spacer peptides). The term "peptide linker" comprises in accordance with the present invention an amino acid sequence by which the amino acid sequences of one (variable and/or binding) domain and another (variable and/or binding) domain of the antibody construct of the invention are linked with each other. An essential technical feature of such peptide linker is that it does not comprise any polymerization activity. Among the suitable peptide linkers are those described in U.S. Pat. Nos. 4,751,180 and 4,935,233 or WO 88/09344. The peptide linkers can also be used to attach other domains or modules or regions (such as half-life extending domains) to the antibody construct of the invention.

In the event that a linker is used, this linker is preferably of a length and sequence sufficient to ensure that each of the first and second domains can, independently from one another, retain their differential binding specificities. For peptide linkers which connect the at least two binding domains (or two variable domains) in the antibody construct of the invention, those peptide linkers are preferred which comprise only a few number of amino acid residues, e.g. 12 amino acid residues or less. Thus, peptide linkers of 12, 11, 10, 9, 8, 7, 6 or 5 amino acid residues are preferred. An envisaged peptide linker with less than 5 amino acids comprises 4, 3, 2 or one amino acid(s), wherein Gly-rich linkers are preferred. A particularly preferred "single" amino acid in the context of said "peptide linker" is Gly. Accordingly, said peptide linker may consist of the single amino acid Gly. Another preferred embodiment of a peptide linker is characterized by the amino acid sequence Gly-Gly-Gly-Gly-Ser, i.e. Gly$_4$Ser (SEQ ID NO: 1), or polymers thereof, i.e. (Gly$_4$Ser)x, where x is an integer of 1 or greater (e.g. 2 or 3). Preferred linkers are depicted in SEQ ID NOs: 1-9. The characteristics of said peptide linker, which comprise the absence of the promotion of secondary structures, are known in the art and are described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which furthermore do not promote any secondary structures are preferred. The linkage of said domains to each other can be provided, e.g., by genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, New York, 2001).

As described herein above, the invention provides a preferred embodiment wherein the antibody construct is in a format selected from the group consisting of (scFv)$_2$, scFv-single domain mAb, diabodies and oligomers of any of the those formats.

According to a particularly preferred embodiment, and as documented in the appended examples, the antibody construct of the invention is a "bispecific single chain antibody construct", more preferably a bispecific "single chain Fv" (scFv). Although the two domains of the Fv fragment, VL and VH, are coded for by separate genes, they can be joined, using recombinant methods, by a synthetic linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are whole or full-length antibodies. A single-chain variable fragment (scFv) is hence a fusion protein of the variable region of the heavy chain (VH) and of the light chain (VL) of immunoglobulins, usually connected with a short linker peptide of about ten to about 25 amino acids, preferably about 15 to 20 amino acids. The linker is usually rich in glycine for flexibility, as well as serine or threonine for solubility, and can either connect the N-terminus of the VH with the C-terminus of the VL, or vice versa. This protein retains the specificity of the original immunoglobulin, despite removal of the constant regions and introduction of the linker.

Bispecific single chain molecules are known in the art and are described in WO99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56. Techniques described for the production of single chain antibodies (see, inter alia, U.S. Pat. No. 4,946, 778, Kontermann and Dübel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs having the format (scFv)$_2$ can be engineered by linking two scFv molecules (e.g. with linkers as described hereinbefore). If these two scFv molecules have the same binding specificity, the resulting (scFv)$_2$ molecule will preferably be called bivalent (i.e. it has two valences for the same target epitope). If the two scFv molecules have different binding specificities, the resulting (scFv)$_2$ molecule will preferably be called bispecific. The linking can be done by producing a single peptide chain with two VH regions and two VL regions, yielding tandem scFvs (see e.g. Kufer P. et al., (2004) Trends in Biotechnology 22(5):238-244). Another possibility is the creation of scFv molecules with linker peptides that are too short for the two variable regions to fold together (e.g. about five amino acids), forcing the scFvs to dimerize. This type is known as diabodies (see e.g. Hollinger, Philipp et al., (July 1993) Proceedings of the National Academy of Sciences of the United States of America 90 (14): 6444-8.).

According to an also preferred embodiment of the antibody construct of the invention the heavy chain (VH) and of the light chain (VL) of a binding domain binding either to the targe antigen MSLN or CD3 are not directly connected via an above described peptide linker but the binding domain is formed due to the formation of a bispecifc molecule as described for the diabody. Thus, the VH chain of the CD3 binding domain may be fused to the VL of the MSLN binding domain via such peptide linker, while the VH chain of the MSLN binding domain is fused to the VL of the CD3 binding domain via such peptide linker.

Single domain antibodies comprise merely one (monomeric) antibody variable domain which is able to bind selectively to a specific antigen, independently of other V regions or domains. The first single domain antibodies were engineered from heavy chain antibodies found in camelids, and these are called V$_H$H fragments. Cartilaginous fishes also have heavy chain antibodies (IgNAR) from which single domain antibodies called V$_{NAR}$ fragments can be obtained. An alternative approach is to split the dimeric variable domains from common immunoglobulins e.g. from humans or rodents into monomers, hence obtaining VH or VL as a single domain Ab. Although most research into single domain antibodies is currently based on heavy chain variable domains, nanobodies derived from light chains have also been shown to bind specifically to target epitopes. Examples of single domain antibodies are called sdAb, nanobodies or single variable domain antibodies.

A (single domain mAb)$_2$ is hence a monoclonal antibody construct composed of (at least) two single domain monoclonal antibodies, which are individually selected from the group comprising VH, VL, V$_H$H and V$_{NAR}$. The linker is preferably in the form of a peptide linker. Similarly, an "scFv-single domain mAb" is a monoclonal antibody construct composed of at least one single domain antibody as described above and one scFv molecule as described above. Again, the linker is preferably in the form of a peptide linker.

It is furthermore envisaged that the present invention provides a bispecific antibody construct comprising a first binding domain which binds to human MSLN on the surface of a target cell and a second binding domain which binds to human CD3 on the surface of a T cell, wherein the first binding domain binds to an epitope of MSLN which is comprised within the region as depicted in SEQ ID NO: 245 (cluster 2+3).

Accordingly, in a further aspect of the invention, the first binding domain of the bispecific antibody construct comprises a VH region comprising CDR-H1, CDR-H2 and CDR-H3 and a VL region comprising CDR-L1, CDR-L2 and CDR-L3 selected from the group consisting of:
a) CDR-H1 as depicted in SEQ ID NO: 161, CDR-H2 as depicted in SEQ ID NO: 162, CDR-H3 as depicted in SEQ ID NO: 163, CDR-L1 as depicted in SEQ ID NO: 164, CDR-L2 as depicted in SEQ ID NO: 165 and CDR-L3 as depicted in SEQ ID NO: 166;
b) CDR-H1 as depicted in SEQ ID NO: 171, CDR-H2 as depicted in SEQ ID NO: 172, CDR-H3 as depicted in SEQ ID NO: 173, CDR-L1 as depicted in SEQ ID NO: 174, CDR-L2 as depicted in SEQ ID NO: 175 and CDR-L3 as depicted in SEQ ID NO: 176;
c) CDR-H1 as depicted in SEQ ID NO: 181, CDR-H2 as depicted in SEQ ID NO: 182, CDR-H3 as depicted in SEQ ID NO: 183, CDR-L1 as depicted in SEQ ID NO: 184, CDR-L2 as depicted in SEQ ID NO: 185 and CDR-L3 as depicted in SEQ ID NO: 186;
d) CDR-H1 as depicted in SEQ ID NO: 191, CDR-H2 as depicted in SEQ ID NO: 192, CDR-H3 as depicted in SEQ ID NO: 193, CDR-L1 as depicted in SEQ ID NO: 194, CDR-L2 as depicted in SEQ ID NO: 195 and CDR-L3 as depicted in SEQ ID NO: 196;
e) CDR-H1 as depicted in SEQ ID NO: 201, CDR-H2 as depicted in SEQ ID NO: 202, CDR-H3 as depicted in SEQ ID NO: 203, CDR-L1 as depicted in SEQ ID NO: 204, CDR-L2 as depicted in SEQ ID NO: 205 and CDR-L3 as depicted in SEQ ID NO: 206.

In one embodiment, the first binding domain of the antibody construct of the invention comprises a VH region selected from the group consisting of those depicted in SEQ ID NO: 167, SEQ ID NO: 177, SEQ ID NO: 187, SEQ ID NO: 197, and SEQ ID NO: 207.

In a further embodiment, the first binding domain of the antibody construct of the invention comprises a VL region selected from the group consisting of those depicted in SEQ ID NO: 168, SEQ ID NO: 178, SEQ ID NO: 188, SEQ ID NO: 198, and SEQ ID NO: 208.

In another embodiment, the first binding domain of the antibody construct of the invention comprises a VH region and a VL region selected from the group consisting of pairs of a VH region and a VL region as depicted in SEQ ID NO: 167+168, SEQ ID NO: 177+178, SEQ ID NO: 187+188, SEQ ID NO: 197+198, and SEQ ID NO: 207+208.

In a further embodiment, the first binding domain of the antibody construct of the invention comprises a polypeptide selected from the group consisting of those depicted in SEQ ID NO: 169, SEQ ID NO: 179, SEQ ID NO: 189, SEQ ID NO: 199, and SEQ ID NO: 209.

It is also envisaged that the present invention provides a bispecific antibody construct comprising a first binding domain which binds to human MSLN on the surface of a target cell and a second binding domain which binds to human CD3 on the surface of a T cell, wherein the first binding domain binds to an epitope of MSLN which is comprised within the region as depicted in SEQ ID NO: 244 (cluster 1+2).

Accordingly, in a further aspect of the invention, the first binding domain of the bispecific antibody construct comprises a VH region comprising CDR-H1, CDR-H2 and CDR-H3 and a VL region comprising CDR-L1, CDR-L2 and CDR-L3 as follows:
(a) CDR-H1 as depicted in SEQ ID NO: 151, CDR-H2 as depicted in SEQ ID NO: 152, CDR-H3 as depicted in SEQ ID NO: 153, CDR-L1 as depicted in SEQ ID NO: 154, CDR-L2 as depicted in SEQ ID NO: 155 and CDR-L3 as depicted in SEQ ID NO: 156; or (b) CDR-H1 as depicted in SEQ ID NO: 221, CDR-H2 as depicted in SEQ ID NO: 222, CDR-H3 as depicted in SEQ ID NO: 223, CDR-L1 as depicted in SEQ ID NO: 224, CDR-L2 as depicted in SEQ ID NO: 225 and CDR-L3 as depicted in SEQ ID NO: 226.

In one embodiment, the first binding domain of the antibody construct of the invention comprises a VH region depicted in SEQ ID NO: 157 or SEQ ID NO: 227.

In a further embodiment, the first binding domain of the antibody construct of the invention comprises a VL region depicted in SEQ ID NO: 158, and SEQ ID NO: 228.

In another embodiment, the first binding domain of the antibody construct of the invention comprises a VH region and a VL region selected from the group consisting of pairs of a VH region and a VL region as depicted in SEQ ID NO: 157+158, and SEQ ID NO: 227+228.

In a further embodiment, the first binding domain of the antibody construct of the invention comprises a polypeptide selected from the group consisting of those depicted in SEQ ID NO: 159, and SEQ ID NO: 229.

It is also envisaged that the present invention provides a bispecific antibody construct comprising a first binding domain which binds to human MSLN on the surface of a target cell and a second binding domain which binds to human CD3 on the surface of a T cell, wherein the first binding domain binds to an epitope of MSLN which is comprised within the region as depicted in SEQ ID NO: 241 (cluster 4).

Accordingly, in a further aspect of the invention, the first binding domain of the bispecific antibody construct comprises a VH region comprising CDR-H1 as depicted in SEQ ID NO: 211, CDR-H2 as depicted in SEQ ID NO: 212, CDR-H3 as depicted in SEQ ID NO: 213, CDR-L1 as depicted in SEQ ID NO: 214, CDR-L2 as depicted in SEQ ID NO: 215 and CDR-L3 as depicted in SEQ ID NO: 216.

In one embodiment, the first binding domain of the antibody construct of the invention comprises a VH region depicted in SEQ ID NO: 217.

In a further embodiment, the first binding domain of the antibody construct of the invention comprises a VL region depicted in SEQ ID NO: 218.

In another embodiment, the first binding domain of the antibody construct of the invention comprises a VH region and a VL region as depicted in SEQ ID NO: 217+218.

In a further embodiment, the first binding domain of the antibody construct of the invention comprises a polypeptide as depicted in SEQ ID NO: 219.

Another preferred antibody construct according to the invention can also be defined as a bispecific antibody construct comprising a first (preferably human) binding domain which binds to human MSLN on the surface of a target cell and a second binding domain which binds to human CD3 on the surface of a T cell, wherein the first binding domain competes for binding with an antibody selected from the group consisting of MS-3, MS-4 and MS-5, i.e., an antibody comprising a VH region comprising CDR-H1, CDR-H2 and CDR-H3 and a VL region comprising CDR-L1, CDR-L2 and CDR-L3 selected from the group consisting of those described above.

T cells or T lymphocytes are a type of lymphocyte (itself a type of white blood cell) that play a central role in cell-mediated immunity. There are several subsets of T cells, each with a distinct function. T cells can be distinguished from other lymphocytes, such as B cells and NK cells, by the presence of a T cell receptor (TCR) on the cell surface. The TCR is responsible for recognizing antigens bound to major histocompatibility complex (MHC) molecules and is composed of two different protein chains. In 95% of the T cells, the TCR consists of an alpha (a) and beta (8) chain. When the TCR engages with antigenic peptide and MHC (peptide/MHC complex), the T lymphocyte is activated through a series of biochemical events mediated by associated enzymes, co-receptors, specialized adaptor molecules, and activated or released transcription factors The CD3 receptor complex is a protein complex and is composed of four chains. In mammals, the complex contains a CD3γ (gamma) chain, a CD3δ (delta) chain, and two CD3ε (epsilon) chains. These chains associate with the T cell receptor (TCR) and the so-called ζ (zeta) chain to form the T cell receptor CD3 complex and to generate an activation signal in T lymphocytes. The CD3γ (gamma), CD3δ (delta), and CD3ε (epsilon) chains are highly related cell-surface proteins of the immunoglobulin superfamily containing a single extracellular immunoglobulin domain. The intracellular tails of the CD3 molecules contain a single conserved motif known as an immunoreceptor tyrosine-based activation motif or ITAM for short, which is essential for the signaling capacity of the TCR. The CD3 epsilon molecule is a polypeptide which in humans is encoded by the CD3E gene which resides on chromosome 11. The most preferred epitope of CD3 epsilon is comprised within amino acid residues 1-27 of the human CD3 epsilon extracellular domain.

The redirected lysis of target cells via the recruitment of T cells by a multispecific, at least bispecific, antibody construct involves cytolytic synapse formation and delivery of perform and granzymes. The engaged T cells are capable of serial target cell lysis, and are not affected by immune escape mechanisms interfering with peptide antigen processing and presentation, or clonal T cell differentiation; see, for example, WO 2007/042261.

Cytotoxicity mediated by MSLN×CD3 bispecific antibody constructs can be measured in various ways. See Examples 5. Effector cells can be e.g. stimulated enriched (human) CD8 positive T cells or unstimulated (human) peripheral blood mononuclear cells (PBMC). If the target cells are of macaque origin or express or are transfected with macaque MSLN, the effector cells should also be of macaque origin such as a macaque T cell line, e.g. 4119LnPx. The target cells should express (at least the extracellular domain of) MSLN, e.g. human or macaque MSLN. Target cells can be a cell line (such as CHO) which is stably or transiently transfected with MSLN, e.g. human or macaque MSLN. Alternatively, the target cells can be a MSLN positive natural expresser cell line, such as the human cell line OVCAR-8. Usually EC50 values are expected to be lower with target cell lines expressing higher levels of MSLN on the cell surface. The effector to target cell (E:T) ratio is usually about 10:1, but can also vary. Cytotoxic activity of MSLN×CD3 bispecific antibody constructs can be measured in a 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by MSLN×CD3 bispecific antibody constructs of the present invention is preferably measured in a cell-based cytotoxicity assay. It may also be measured in a 51-chromium release assay. It is represented by the $EC_{50}$ value, which corresponds to the half maximal effective concentration (concentration of the antibody construct which induces a cytotoxic response halfway between the baseline and maximum). Preferably, the $EC_{50}$ value of the MSLN×CD3 bispecific antibody constructs is ≤5000 pM or ≤4000 pM, more preferably ≤3000 pM or ≤2000 pM, even more preferably ≤1000 pM or ≤500 pM, even more preferably ≤400 pM or ≤300 pM, even more preferably ≤200 pM, even more preferably 100 pM, even more preferably ≤50 pM, even more preferably ≤20 pM or ≤0 pM, and most preferably ≤5 pM.

The above given $EC_{50}$ values can be measured in different assays. The skilled person is aware that an $EC_{50}$ value can be expected to be lower when stimulated/enriched CD8+ T cells are used as effector cells, compared with unstimulated PBMC. It can furthermore be expected that the $EC_{50}$ values are lower when the target cells express a high number of the target antigen compared with a low target expression rat. For example, when stimulated/enriched human CD8+ T cells are used as effector cells (and either MSLN transfected cells such as CHO cells or a MSLN positive human cell line OVCAR-8 are used as target cells), the $EC_{50}$ value of the MSLN×CD3 bispecific antibody construct is preferably ≤1000 pM, more preferably ≤500 pM, even more preferably ≤250 pM, even more preferably ≤100 pM, even more preferably ≤50 pM, even more preferably ≤0 pM, and most preferably pM. When human PBMCs are used as effector cells, the $EC_{50}$ value of the MSLN×CD3 bispecific antibody construct is preferably ≤5000 pM or ≤4000 pM (in particular when the target cells are a MSLN positive human cell line OVCAR-8), more preferably ≤2000 pM (in particular when the target cells are MSLN transfected cells such as CHO cells), more preferably ≤1000 pM or ≤500 pM, even more preferably ≤200 pM, even more preferably ≤150 pM, even more preferably ≤100 pM, and most preferably ≤50 pM, or lower. When a macaque T cell line such as LnPx4119 is used as effector cells, and a macaque MSLN transfected cell line such as CHO cells is used as target cell line, the $EC_{50}$ value of the MSLN xCD3 bispecific antibody construct is preferably ≤2000 pM or ≤1500 pM, more preferably ≤1000 pM or ≤500 pM, even more preferably ≤300 pM or ≤250 pM, even more preferably ≤100 pM, and most preferably ≤50 pM.

Preferably, the MSLN×CD3 bispecific antibody constructs of the present invention do not induce/mediate lysis or do not essentially induce/mediate lysis of MSLN negative cells such as CHO cells. The term "do not induce lysis", "do not essentially induce lysis", "do not mediate lysis" or "do not essentially mediate lysis" means that an antibody construct of the present invention does not induce or mediate lysis of more than 30%, preferably not more than 20%, more preferably not more than 10%, particularly preferably not more than 9%, 8%, 7%, 6% or 5% of MSLN negative cells, whereby lysis of a MSLN positive human cell line OVCAR-8 (see above) is set to be 100%. This usually applies for concentrations of the antibody construct of up to 500 nM. The skilled person knows how to measure cell lysis without further ado. Moreover, the present specification teaches specific instructions how to measure cell lysis.

The difference in cytotoxic activity between the monomeric and the dimeric isoform of individual MSLN×CD3 bispecific antibody constructs is referred to as "potency gap". This potency gap can e.g. be calculated as ratio between $EC_{50}$ values of the molecule's monomeric and dimeric form, see Example 5.8. Potency gaps of the MSLN× CD3 bispecific antibody constructs of the present invention are preferably ≤5, more preferably ≤4, even more preferably ≤3, even more preferably ≤2, furthermore preferably ≤1, and most preferably ≤0.3.

The first and/or the second (or any further) binding domain(s) of the antibody construct of the invention is/are preferably cross-species specific for members of the mammalian order of primates. Cross-species specific CD3 binding domains are, for example, described in WO 2008/119567. According to one embodiment, the first and/or second binding domain, in addition to binding to human MSLN and human CD3, respectively, will also bind to MSLN/CD3 of primates including (but not limited to) new world primates (such as *Callithrix jacchus, Saguinus Oedipus* or *Saimiri sciureus*), old world primates (such baboons and macaques), gibbons, orangutans, and non-human homininae. It is envisaged that the first binding domain of the antibody construct of the invention which binds to human MSLN on the surface of a target cell also binds at least to macaque MSLN, and/or the second binding domain which binds to human CD3 on the surface of a T cell also binds at least to macaque CD3. A preferred macaque is *Macaca fascicularis. Macaca mulatta* (Rhesus) is also envisaged.

In one aspect of the invention, the first binding domain binds to human MSLN and further binds to macaque MSLN, such as MSLN of *Macaca fascicularis*, and more preferably, to macaque MSLN expressed on the surface macaque cells. A preferred *Macaca fascicularis* MSLN is depicted in SEQ ID NO: 234. The affinity of the first binding domain for macaque MSLN is preferably ≤15 nM, more preferably ≤0 nM, even more preferably ≤1 nM, even more preferably ≤1 nM, even more preferably ≤0.5 nM, even more preferably ≤0.1 nM, and most preferably ≤0.05 nM or even ≤0.01 nM.

Preferably the affinity gap of the antibody constructs according to the invention for binding macaque MSLN versus human MSLN [ma MSLN:hu MSLN] (as determined e.g. by BIACORE™ or by Scatchard analysis) is <100, preferably <20, more preferably <15, further preferably <10, even more preferably <8, more preferably <6 and most preferably <2. Preferred ranges for the affinity gap of the antibody constructs according to the invention for binding macaque MSLN versus human MSLN are between 0.1 and 20, more preferably between 0.2 and 10, even more preferably between 0.3 and 6, even more preferably between 0.5 and 3 or between 0.5 and 2.5, and most preferably between 0.5 and 2 or between 0.6 and 2. See Examples 3.

Accordingly, in line with this invention antibody construct comprising a MSLN binder for the epitope cluster 2+3 are preferred, which all are shown to have an affinity gap≤15. Further preferred are antibody construct comprising a MSLN binder for the epitope cluster 2+3 having an affinity gap≤6, such as MS-3, MS-4 or MS-5 based bispecific antibody constructs.

In one embodiment of the antibody construct of the invention, the second binding domain binds to human CD3 epsilon and to *Callithrix jacchus, Saguinus Oedipus* or *Saimiri sciureus* CD3 epsilon. Preferably, the second binding domain binds to an extracellular epitope of these CD3 epsilon chains. It is also envisaged that the second binding domain binds to an extracellular epitope of the human and the *Macaca* CD3 epsilon chain. The most preferred epitope of CD3 epsilon is comprised within amino acid residues 1-27 of the human CD3 epsilon extracellular domain. Even more specifically, the epitope comprises at least the amino acid sequence Gln-Asp-Gly-Asn-Glu. *Callithrix jacchus* and *Saguinus oedipus* are both new world primate belonging to the family of Callitrichidae, while *Saimiri sciureus* is a new world primate belonging to the family of Cebidae.

It is particularly preferred for the antibody construct of the present invention that the second binding domain which binds to human CD3 on the surface of a T cell comprises a VL region comprising CDR-L1, CDR-L2 and CDR-L3 selected from:

(a) CDR-L1 as depicted in SEQ ID NO: 27 of WO 2008/119567 (SEQ ID NO: 20 herein), CDR-L2 as depicted in SEQ ID NO: 28 of WO 2008/119567 (SEQ ID NO: 21 herein) and CDR-L3 as depicted in SEQ ID NO: 29 of WO 2008/119567 (SEQ ID NO: 22 herein);

(b) CDR-L1 as depicted in SEQ ID NO: 117 of WO 2008/119567 (SEQ ID NO: 65 herein), CDR-L2 as depicted in SEQ ID NO: 118 of WO 2008/119567 (SEQ ID NO: 66 herein) and CDR-L3 as depicted in SEQ ID NO: 119 of WO 2008/119567 (SEQ ID NO: 67 herein); and (c) CDR-L1 as depicted in SEQ ID NO: 153 of WO 2008/119567 (SEQ ID NO: 83 herein), CDR-L2 as depicted in SEQ ID NO: 154 of WO 2008/119567 (SEQ ID NO: 84 herein) and CDR-L3 as depicted in SEQ ID NO: 155 of WO 2008/119567 (SEQ ID NO: 85 herein.

In an alternatively preferred embodiment of the antibody construct of the present invention, the second binding domain which binds to human CD3 on the surface of a T cell comprises a VH region comprising CDR-H 1, CDR-H2 and CDR-H3 selected from:

(a) CDR-H1 as depicted in SEQ ID NO: 12 of WO 2008/119567 (SEQ ID NO: 14 herein), CDR-H2 as depicted in SEQ ID NO: 13 of WO 2008/119567 (SEQ ID NO: 15 herein) and CDR-H3 as depicted in SEQ ID NO: 14 of WO 2008/119567 (SEQ ID NO: 16 herein);

(b) CDR-H1 as depicted in SEQ ID NO: 30 of WO 2008/119567 (SEQ ID NO: 23 herein), CDR-H2 as depicted in SEQ ID NO: 31 of WO 2008/119567 (SEQ ID NO: 24 herein) and CDR-H3 as depicted in SEQ ID NO: 32 of WO 2008/119567 (SEQ ID NO: 25 herein);

(c) CDR-H1 as depicted in SEQ ID NO: 48 of WO 2008/119567 (SEQ ID NO: 32 herein), CDR-H2 as depicted in SEQ ID NO: 49 of WO 2008/119567 (SEQ ID NO: 33 herein) and CDR-H3 as depicted in SEQ ID NO: 50 of WO 2008/119567 (SEQ ID NO: 34 herein;

(d) CDR-H1 as depicted in SEQ ID NO: 66 of WO 2008/119567 (SEQ ID NO: 41 herein), CDR-H2 as depicted in SEQ ID NO: 67 of WO 2008/119567 (SEQ ID NO: 42 herein) and CDR-H3 as depicted in SEQ ID NO: 68 of WO 2008/119567 (SEQ ID NO: 43 herein;

(e) CDR-H1 as depicted in SEQ ID NO: 84 of WO 2008/119567 (SEQ ID NO: 50 herein), CDR-H2 as depicted in SEQ ID NO: 85 of WO 2008/119567 (SEQ ID NO: 51 herein) and CDR-H3 as depicted in SEQ ID NO: 86 of WO 2008/119567 (SEQ ID NO: 52 herein);

(f) CDR-H1 as depicted in SEQ ID NO: 102 of WO 2008/119567 (SEQ ID NO: 59 herein), CDR-H2 as depicted in SEQ ID NO: 103 of WO 2008/119567 (SEQ ID NO: 60 herein) and CDR-H3 as depicted in SEQ ID NO: 104 of WO 2008/119567 (SEQ ID NO: 61 herein);

(g) CDR-H1 as depicted in SEQ ID NO: 120 of WO 2008/119567 (SEQ ID NO: 68 herein, CDR-H2 as depicted in SEQ ID NO: 121 (SEQ ID NO: 69 herein) of WO 2008/119567 and CDR-H3 as depicted in SEQ ID NO: 122 of WO 2008/119567 (SEQ ID NO: 70 herein);

(h) CDR-H1 as depicted in SEQ ID NO: 138 of WO 2008/119567 (SEQ ID NO: 77 herein, CDR-H2 as depicted in SEQ ID NO: 139 of WO 2008/119567 (SEQ ID NO: 78 herein) and CDR-H3 as depicted in SEQ ID NO: 140 of WO 2008/119567 (SEQ ID NO: 79 herein;

(i) CDR-H1 as depicted in SEQ ID NO: 156 of WO 2008/119567 (SEQ ID NO: 86 herein), CDR-H2 as depicted in SEQ ID NO: 157 of WO 2008/119567 (SEQ ID NO: 87 herein) and CDR-H3 as depicted in SEQ ID NO: 158 of WO 2008/119567 (SEQ ID NO: 88 herein); and (j) CDR-H1 as depicted in SEQ ID NO: 174 of WO 2008/119567 (SEQ ID NO: 95 herein, CDR-H2 as depicted in SEQ ID NO: 175 of WO 2008/119567 (SEQ ID NO: 96 herein) and CDR-H3 as depicted in SEQ ID NO: 176 of WO 2008/119567 (SEQ ID NO: 97 herein).

It is further preferred for the antibody construct of the present invention that the second binding domain which binds to human CD3 on the surface of a T cell comprises a VL region selected from the group consisting of a VL region as depicted in SEQ ID NO: 18, SEQ ID NO: 27, SEQ ID NO: 36, SEQ ID NO: 45, SEQ ID NO: 54, SEQ ID NO: 63, SEQ ID NO: 72, SEQ ID NO: 81, SEQ ID NO: 90, SEQ ID NO: 99, and SEQ ID NO: 102 (see also SEQ ID NO: 35 (SEQ ID NO: 27 herein), 39 (SEQ ID NO: 305 herein), 125 (SEQ ID NO: 72 herein), 129 (SEQ ID NO: 306 herein), 161 (SEQ ID NO: 90 herein) or 165 (SEQ ID NO: 307 herein) of WO 2008/119567).

It is alternatively preferred that the second binding domain which binds to human CD3 on the surface of a T cell comprises a VH region selected from the group consisting of a VH region as depicted in SEQ ID NO: 17, SEQ ID NO: 26, SEQ ID NO: 35, SEQ ID NO: 44, SEQ ID NO: 53, SEQ ID NO: 62, SEQ ID NO: 71, SEQ ID NO: 80, SEQ ID NO: 89, SEQ ID NO: 98, and SEQ ID NO: 101 (see also SEQ ID NO: 15 (SEQ ID NO: 17 herein), 19 (SEQ ID NO: 308 herein), 33 (SEQ ID NO: 26 herein), 37 (SEQ ID NO: 309 herein), 51 (SEQ ID NO: 35 herein), 55 (SEQ ID NO: 310 herein), 69 (SEQ ID NO: 44 herein), 73 (SEQ ID NO: 311 herein), 87 (SEQ ID NO: 53 herein), 91 (SEQ ID NO: 312 herein), 105 SEQ ID NO: 62 herein), 109 (SEQ ID NO: 313 herein), 123 (SEQ ID NO: 71 herein), 127 (SEQ ID NO: 314 herein), 141 (SEQ ID NO: 80 herein), 145 (SEQ ID NO: 315 herein), 159 (SEQ ID NO: 89 herein), 163 (SEQ ID NO: 316 herein), 177 (SEQ ID NO: 98 herein) or 181 SEQ ID NO: 317 herein) of WO 2008/119567).

More preferably, the antibody construct of the present invention is characterized by the second binding domain which binds to human CD3 on the surface of a T cell comprising a VL region and a VH region selected from the group consisting of:

(a) a VL region as depicted in SEQ ID NO: 17 or 21 of WO 2008/119567 (SEQ ID NO: 17 of WO2008/119567 is SEQ ID NO: 18 herein; SEQ ID NO: 21 is SEQ ID NO: 305 herein) and a VH region as depicted in SEQ ID NO: 15 or 19 of WO 2008/119567 (SEQ ID NO: 15 is SEQ ID NO: 17 herein; SEQ ID NO: 19 is SEQ ID NO: 308 herein);

(b) a VL region as depicted in SEQ ID NO: 35 or 39 of WO 2008/119567 (SEQ ID NO: 35 is SEQ ID NO: 27 herein; SEQ ID NO: 39 is SEQ ID NO: 305 herein) and a VH region as depicted in SEQ ID NO: 33 or 37 of WO 2008/119567 (SEQ ID NO: 33 is SEQ ID NO: 26 herein; SEQ ID NO: 37 is SEQ ID NO: 309 herein);

(c) a VL region as depicted in SEQ ID NO: 53 or 57 of WO 2008/119567 (SEQ ID NO: 53 is SEQ ID NO: 36 herein; SEQ ID NO: 57 is SEQ ID NO: 305 herein) and a VH region as depicted in SEQ ID NO: 51 or 55 of WO 2008/119567 (SEQ ID NO: 51 is SEQ ID NO: 35 herein; SEQ ID NO: 55 is SEQ ID NO: 310 herein);

(d) a VL region as depicted in SEQ ID NO: 71 or 75 of WO 2008/119567 (SEQ ID NO: 71 is SEQ ID NO: 17 herein; SEQ ID NO: 75 is SEQ ID NO: 305 herein) and a VH region as depicted in SEQ ID NO: 69 or 73 of WO 2008/119567 (SEQ ID NO: 69 is SEQ ID NO: 44 herein; SEQ ID NO: 73 is SEQ ID NO: 311 herein);

(e) a VL region as depicted in SEQ ID NO: 89 or 93 of WO 2008/119567 (SEQ ID NO: 89 is SEQ ID NO: 54 herein; SEQ ID NO: 93 is SEQ ID NO: 306 herein) and a VH region as depicted in SEQ ID NO: 87 or 91 of WO 2008/119567 (SEQ ID NO: 87 is SEQ ID NO: 53 herein; SEQ ID NO: 91 is SEQ ID NO: 312 herein);

(f) a VL region as depicted in SEQ ID NO: 107 or 111 of WO 2008/119567 (SEQ ID NO: 107 is SEQ ID NO: 63 herein; SEQ ID NO: 111 is SEQ ID NO: 306 herein) and a VH region as depicted in SEQ ID NO: 105 or 109 of WO 2008/119567 (SEQ ID NO: 105 is SEQ ID NO: 62 herein; SEQ ID NO: 109 is SEQ ID NO: 313 herein);

(g) a VL region as depicted in SEQ ID NO: 125 or 129 of WO 2008/119567 (SEQ ID NO: 125 is SEQ ID NO: 72 herein; SEQ ID NO: 129 is SEQ ID NO: 306 herein) and a VH region as depicted in SEQ ID NO: 123 or 127 of WO 2008/119567 (SEQ ID NO: 123 is SEQ ID NO: 71 herein; SEQ ID NO: 127 is SEQ ID NO: 314 herein);

(h) a VL region as depicted in SEQ ID NO: 143 or 147 of WO 2008/119567 (SEQ ID NO: 143 is SEQ ID NO: 81 herein; SEQ ID NO: 147 is SEQ ID NO: 305 herein) and a VH region as depicted in SEQ ID NO: 141 or 145 of WO 2008/119567 (SEQ ID NO: 141 is SEQ ID NO: 80 herein; SEQ ID NO: 145 is SEQ ID NO: 315 herein);

(i) a VL region as depicted in SEQ ID NO: 161 or 165 of WO 2008/119567 (SEQ ID NO: 161 is SEQ ID NO: 90 herein; SEQ ID NO: 165 is SEQ ID NO: 307 herein) and a VH region as depicted in SEQ ID NO: 159 or 163 of (SEQ ID NO: 159 is SEQ ID NO: 89 herein; SEQ ID NO: 163 is SEQ ID NO: 316 herein) WO 2008/119567; and (j) a VL region as depicted in SEQ ID NO: 179 or 183 of WO 2008/119567 (SEQ ID NO: 179 is SEQ ID NO: 99 herein; SEQ ID NO: 183 is SEQ ID NO: 307 herein) and a VH region as depicted in SEQ ID NO: 177 or 181 of WO 2008/119567 (SEQ ID NO: 177 is SEQ ID NO: 98 herein; SEQ ID NO: 181 is SEQ ID NO: 317 herein).

Also preferred in connection with the antibody construct of the present invention is a second binding domain which binds to human CD3 on the surface of a T cell comprising a VL region as depicted in SEQ ID NO: 102 and a VH region as depicted in SEQ ID NO: 101.

According to a preferred embodiment of the antibody construct of the present invention, the binding domains and in particular the second binding domain (which binds to human CD3 on the surface of a T cell) have the following format: The pairs of VH regions and VL regions are in the format of a single chain antibody (scFv). The VH and VL regions are arranged in the order VH-VL or VL-VH. It is preferred that the VH-region is positioned N-terminally of a linker sequence, and the VL-region is positioned C-terminally of the linker sequence.

A preferred embodiment of the above described antibody construct of the present invention is characterized by the second binding domain which binds to human CD3 on the surface of a T cell comprising an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103 (see also SEQ ID NOs: 23 (SEQ ID NO: 19 herein), 25 (SEQ ID NO: 318 herein), 41 (SEQ ID NO: 28 herein), 43 (SEQ ID NO: 319 herein), 59 (SEQ ID NO: 37 herein), 61 (SEQ ID NO: 320 herein), 77 (SEQ ID NO: 46 herein), 79 (SEQ ID NO: 321 herein), 95 (SEQ ID NO: 55 herein), 97 (SEQ ID NO: 322, herein), 113 (SEQ ID NO: 64 herein), 115 (SEQ ID NO: 323 herein), 131 (SEQ ID NO: 73 herein), 133 (SEQ ID NO: 324 herein), 149 (SEQ ID NO: 82 herein), 151 (SEQ ID NO: 325 herein), 167 (SEQ ID NO: 91 herein), 169 (SEQ ID NO: 326 herein), 185 (SEQ ID NO: 100 herein) or 187 (SEQ ID NO: 327 herein) of WO 2008/119567).

It is also envisaged that the antibody construct of the invention has, in addition to its function to bind to the target molecules MSLN and CD3, a further function. In this format, the antibody construct is a trifunctional or multifunctional antibody construct by targeting target cells through binding to MSLN, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as a toxin or radionuclide, and/or means to enhance serum half-life, etc.

Examples for means to extend serum half-life of the antibody constructs of the invention include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). An alternative concept of such half-life extending peptides includes peptides binding to the neonatal Fc receptor (FcRn, see WO 2007/098420), which can also be used in the constructs of the present invention. The concept of attaching larger domains of proteins or complete proteins includes e.g. the fusion of human serum albumin, variants or mutants of human serum albumin (see WO 2011/051489, WO 2012/059486, WO 2012/150319, WO 2013/135896, WO 2014/072481, WO 2013/075066) or domains thereof as well as the fusion of constant region of immunoglobulins (Fc domains) and variants thereof. Such variants of Fc domains may be optimized/modified in order to allow the desired pairing of dimers or mulimers, to abolish Fc receptor binding (e.g. the Fcγ receptor) or for other reasons. A further concept known in the art to extend the half-life of small protein compounds in the human body is the pegylation of those compounds such as the antibody construct of the present invention.

In a preferred embodiment, the antibody construct of the invention is described as follows:

(a) a polypeptide comprising in the following order starting from the N-terminus:

a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229 a peptide linker having an amino acid sequence selected from the group consisting of SEQ ID NOs: 1-9; and a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and optionally a His-tag, such as the one depicted in SEQ ID NO 10;

(b) a polypeptide comprising in following order starting from the N-terminus:
- a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229
- a peptide linker having an amino acid sequence selected from the group consisting of SEQ ID NOs: 1-9;
- a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103;
- optionally a peptide linker having an amino acid sequence selected from the group consisting of SEQ ID NOs: 1-9;
- a polypeptide having an amino acid sequence selected from the group consisting of SEQ ID NOs: 104-134; and
- optionally a His-tag, such as the one depicted in SEQ ID NO 10;

(c) a polypeptide comprising in the following order starting from the N-terminus:
- a polypeptide having the amino acid sequence QRFVTGHFGGLX$_1$PANG (SEQ ID NO: 135) whereas X$_1$ is Y or H; and
- a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229;
- a peptide linker having an amino acid sequence selected from the group consisting of SEQ ID NOs: 1-9;
- a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103;
- a polypeptide having the amino acid sequence QRFVTGHFGGLHPANG (SEQ ID NO: 137) or QRFCTGHFGGLHPCNG (SEQ ID NO: 139); and
- optionally a His-tag, such as the one depicted in SEQ ID NO 10;

(d) a polypeptide comprising in the following order starting from the N-terminus
- a polypeptide having an amino acid sequence selected from the group consisting of SEQ ID NO: 17, SEQ ID NO: 26, SEQ ID NO: 35, SEQ ID NO: 44, SEQ ID NO: 53, SEQ ID NO: 62, SEQ ID NO: 71, SEQ ID NO: 80, SEQ ID NO: 89, SEQ ID NO: 98, and SEQ ID NO: 101;
- a peptide linker having the amino acid sequence depicted in SEQ ID NO: 8;
- a polypeptide having an amino acid sequence selected from the group consisting of SEQ ID NO: 158, SEQ ID NO: 168, SEQ ID NO: 178, SEQ ID NO: 188, SEQ ID NO: 198, SEQ ID NO: 208, SEQ ID NO: 218, and SEQ ID NO: 228 and a serine residue at the C-terminus;
- a polypeptide having the amino acid sequence depicted in SEQ ID NO: 140; and
- a polypeptide comprising in the following order starting from the N-terminus:
- a polypeptide having an amino acid sequence selected from the group consisting of SEQ ID NO: 157, SEQ ID NO: 167, SEQ ID NO: 177, SEQ ID NO: 187, SEQ ID NO: 197, SEQ ID NO: 207, SEQ ID NO: 217, and SEQ ID NO: 227;
- a peptide linker having the amino acid sequence depicted in SEQ ID NO: 8;
- a polypeptide having an amino acid sequence selected from the group consisting of SEQ ID NO: 18, SEQ ID NO: 27, SEQ ID NO: 36, SEQ ID NO: 45, SEQ ID NO: 54, SEQ ID NO: 63, SEQ ID NO: 72, SEQ ID NO: 81, SEQ ID NO: 90, SEQ ID NO: 99, and SEQ ID NO: 102 and a serine residue at the C-terminus;
- a polypeptide having the amino acid sequence depicted in SEQ ID NO: 141;

(e) a polypeptide comprising in the following order starting from the N-terminus:
- a polypeptide having an amino acid sequence selected from the group consisting of SEQ ID NO: 17, SEQ ID NO: 26, SEQ ID NO: 35, SEQ ID NO: 44, SEQ ID NO: 53, SEQ ID NO: 62, SEQ ID NO: 71, SEQ ID NO: 80, SEQ ID NO: 89, SEQ ID NO: 98, and SEQ ID NO: 101;
- a peptide linker having the amino acid sequence depicted in SEQ ID NO: 8;
- a polypeptide having an amino acid sequence selected from the group consisting of SEQ ID NO: 158, SEQ ID NO: 168, SEQ ID NO: 178, SEQ ID NO: 188, SEQ ID NO: 198, SEQ ID NO: 208, SEQ ID NO: 218, and SEQ ID NO: 228;
- a polypeptide having the amino acid sequence depicted in SEQ ID NO: 142; and
- a polypeptide comprising in the following order starting from the N-terminus:
- a polypeptide having an amino acid sequence selected from the group consisting of SEQ ID NO: 157, SEQ ID NO: 167, SEQ ID NO: 177, SEQ ID NO: 187, SEQ ID NO: 197, SEQ ID NO: 207, SEQ ID NO: 217, and SEQ ID NO: 227;
- a peptide linker having an amino acid sequence depicted in SEQ ID NO: 8;
- a polypeptide having an amino acid sequence selected from the group consisting of SEQ ID NO: 18, SEQ ID NO: 27, SEQ ID NO: 36, SEQ ID NO: 45, SEQ ID NO: 54, SEQ ID NO: 63, SEQ ID NO: 72, SEQ ID NO: 81, SEQ ID NO: 90, SEQ ID NO: 99, and SEQ ID NO: 102 and a serine residue at the C-terminus;
- a polypeptide having the amino acid sequence depicted in SEQ ID NO: 143;

(f) a polypeptide comprising in the following order starting from the N-terminus:
- a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229;

a peptide linker having an amino acid sequence selected from the group consisting of SEQ ID NOs: 1-9; and a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and a polypeptide having the amino acid sequence depicted in SEQ ID NO: 144; and a polypeptide having the amino acid sequence depicted in SEQ ID NO: 145;

(g) a polypeptide comprising in the following order starting from the N-terminus:

a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229; and a polypeptide having the amino acid sequence depicted in SEQ ID NO: 146; and a polypeptide comprising in the following order starting from the N-terminus:

a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and a polypeptide having the amino acid sequence depicted in SEQ ID NO: 147;

(h) a polypeptide comprising in the following order starting from the N-terminus:

a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229; and a polypeptide having the amino acid sequence depicted in SEQ ID NO: 148; and a polypeptide comprising in the following order starting from the N-terminus:

a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and a polypeptide having the amino acid sequence depicted in SEQ ID NO: 149; or (i) a polypeptide comprising in the following order starting from the N-terminus:

a polypeptide having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229;

a peptide linker having an amino acid sequence selected from the group consisting of SEQ ID NOs: 1-9; and a polypeptide having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and a polypeptide having the amino acid sequence depicted in SEQ ID NO: 150.

As described above, several preferred antibody constructs of the invention are modified by fusion with another moiety such as albumin or albumin variants. If these fusion constructs are characterized for their properties, in particular target affinity or cytotoxic activity, the skilled person will be aware that similar fusion constructs or unmodified bispecific antibody constructs can be expected to have similar (or even better) properties. For example, if a bispecific antibody construct fused with albumin has an appreciable or desirable cytotoxic activity or target affinity, it can be expected that the same/similar or even a higher cytotoxic activity/target affinity will be observed for the construct w/o albumin.

According to another preferred embodiment, the bispecific antibody construct of the invention comprises (in addition to the two binding domains) a third domain which comprises two polypeptide monomers, each comprising a hinge, a CH2 and a CH3 domain, wherein said two polypeptides (or polypeptide monomers) are fused to each other via a peptide linker. Preferably, said third domain comprises in an N- to C-terminal order: hinge-CH2-CH3-linker-hinge-CH2-CH3. Preferred amino acid sequences for said third domain are depicted in SEQ ID NOs: 260-267. Each of said two polypeptide monomers preferably has an amino acid sequence that is selected from the group consisting of SEQ ID NOs: 252-259, or that is at least 90% identical to those sequences. In another preferred embodiment, the first and second binding domains of the bispecific antibody construct of the invention are fused to the third domain via a peptide linker which is for example selected from the group consisting of SEQ ID NOs: 1, 2, 3, 4, 5, 6, 7, 8 and 9.

In line with the present invention, a "hinge" is an IgG hinge region. This region can be identified by analogy using the Kabat numbering, see Kabat positions 223-243. In line with the above, the minimal requirement for a "hinge" are the amino acid residues corresponding to the $IgG_1$ sequence stretch of D231 to P243 according to the Kabat numbering. The terms CH2 and CH3 refer to the immunoglobulin heavy chain constant regions 2 and 3. These regions can as well be identified by analogy using the Kabat numbering, see Kabat positions 244-360 for CH2 and Kabat positions 361-478 for CH3. Is is understood that there is some variation between the immunoglobulins in terms of their $IgG_1$ Fc region, $IgG_2$ Fc region, $IgG_3$ Fc region, $IgG_4$ Fc region, IgM Fc region, IgA Fc region, IgD Fc region and IgE Fc region (see, e.g., Padlan, Molecular Immunology, 31(3), 169-217 (1993)). The term Fc monomer refers to the last two heavy chain constant regions of IgA, IgD, and IgG, and the last three heavy chain constant regions of IgA and IgM. The Fc monomer can also include the flexible hinge N-terminal to these domains. For IgA and IgM, the Fc monomer may include the J chain. For IgG, the Fc portion comprises immunoglobulin domains CH2 and CH3 and the hinge between the first two domains and CH2. Although the boundaries of the Fc portion of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for $IgG_4$, wherein the numbering is according to Kabat.

The antibody construct of the invention may hence comprise in an N- to C-terminal order:
(a) the first binding domain;
(b) a peptide linker having an amino acid sequence selected from the group consisting of SEQ ID NOs: 2, 8 and 9;
(c) the second binding domain;
(d) a peptide linker having an amino acid sequence selected from the group consisting of SEQ ID NOs: 1, 2, 4, 5, 6, 8 and 9;
(e) the first polypeptide monomer of the third domain (comprising a hinge, a CH2 and a CH3 domain);
(f) a peptide linker having an amino acid sequence selected from the group consisting of SEQ ID NOs: 301, 302, 303 and 304; and
(g) the second polypeptide monomer of the third domain (comprising a hinge, a CH2 and a CH3 domain).

It is also preferred that the antibody construct of the invention comprises in an N- to C-terminal order:
the first binding domain having an amino acid sequence selected from the group consisting of SEQ ID NO: 159, SEQ ID NO: 169, SEQ ID NO: 179, SEQ ID NO: 189, SEQ ID NO: 199, SEQ ID NO: 209, SEQ ID NO: 219, and SEQ ID NO: 229;
a peptide linker having an amino acid sequence selected from the group consisting of SEQ ID NOs: 2, 8 and 9;
the second binding domain having an amino acid sequence selected from the group consisting of SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103 (see also SEQ ID NOs: 23, 25, 41, 43, 59, 61, 77, 79, 95, 97, 113, 115, 131, 133, 149, 151, 167, 169, 185 or 187 of WO 2008/119567);
a peptide linker having an amino acid sequence selected from the group consisting of SEQ ID NOs: 1, 2, 4, 5, 6, 8 and 9; and
the third domain having an amino acid sequence selected from the group consisting of SEQ ID NOs: 260-267.

Hence, in a preferred embodiment, the antibody construct of the present invention comprises or consists of a polypeptide selected from the group consisting of those depicted in SEQ ID NOs: 268 to 299.

It is also preferably in one embodiment of the invention that the antibody construct of the present invention comprises or consists of a polypeptide selected from the group consisting of those depicted in SEQ ID NOs: 276 to 287.

Also in a preferred embodiment of the invention that the antibody construct of the present invention comprises or consists of a polypeptide selected from the group consisting of those depicted in SEQ ID NOs: 276, 280 and 284, more preferably comprises or consists of a polypeptide as depicted in SEQ ID NO: 280.

Covalent modifications of the antibody constructs are also included within the scope of this invention, and are generally, but not always, done post-translationally. For example, several types of covalent modifications of the antibody construct are introduced into the molecule by reacting specific amino acid residues of the antibody construct with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}$I or $^{131}$I to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking the antibody constructs of the present invention to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates as described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antibody constructs included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antibody construct is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the amino acid sequence of an antibody construct is preferably altered through changes at the DNA level, particularly by mutating the DNA encoding the polypeptide at preselected bases such that codons are generated that will translate into the desired amino acids.

Another means of increasing the number of carbohydrate moieties on the antibody construct is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330, and in Aplin and Wriston, 1981, CRC Crit. Rev. Biochem., pp. 259-306.

Removal of carbohydrate moieties present on the starting antibody construct may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, Arch. Biochem. Biophys. 259:52 and by Edge et al., 1981, Anal. Biochem. 118:131. Enzymatic cleavage of carbohydrate moieties on polypeptides can be achieved by the use of a variety of endo- and exo-glycosidases as described by Thotakura et al., 1987, Meth. Enzymol. 138:350. Glycosylation at potential glycosylation sites may be prevented by the use of the compound tunicamycin as described by Duskin et al., 1982, J. Biol. Chem. 257:3105. Tunicamycin blocks the formation of protein-N-glycoside linkages.

Other modifications of the antibody construct are also contemplated herein. For example, another type of covalent modification of the antibody construct comprises linking the antibody construct to various non-proteinaceous polymers, including, but not limited to, various polyols such as polyethylene glycol, polypropylene glycol, polyoxyalkylenes, or copolymers of polyethylene glycol and polypropylene glycol, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antibody construct, e.g. in order to facilitate the addition of polymers such as PEG.

In some embodiments, the covalent modification of the antibody constructs of the invention comprises the addition of one or more labels. The labelling group may be coupled to the antibody construct via spacer arms of various lengths to reduce potential steric hindrance. Various methods for labelling proteins are known in the art and can be used in performing the present invention. The term "label" or "labelling group" refers to any detectable label. In general, labels fall into a variety of classes, depending on the assay in which they are to be detected—the following examples include, but are not limited to:

a) isotopic labels, which may be radioactive or heavy isotopes, such as radioisotopes or radionuclides (e.g., $^3$H, $^{14}$C, $^{15}$N, $^{35}$S, $^{89}$Zr, $^{90}$Y, $^{99}$Tc, $^{111}$In, $^{125}$I, $^{131}$I)
b) magnetic labels (e.g., magnetic particles)
c) redox active moieties
d) optical dyes (including, but not limited to, chromophores, phosphors and fluorophores) such as fluorescent groups (e.g., FITC, rhodamine, lanthanide phosphors), chemiluminescent groups, and fluorophores which can be either "small molecule" fluores or proteinaceous fluores
e) enzymatic groups (e.g. horseradish peroxidase, β-galactosidase, luciferase, alkaline phosphatase)
f) biotinylated groups
g) predetermined polypeptide epitopes recognized by a secondary reporter (e.g., leucine zipper pair sequences, binding sites for secondary antibodies, metal binding domains, epitope tags, etc.)

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, OR), FITC, Rhodamine, and Texas Red (Pierce, Rockford, IL), Cy5, Cy5.5, Cy7 (Amersham Life Science, Pittsburgh, PA). Suitable optical dyes, including fluorophores, are described in Molecular Probes Handbook by Richard P. Haugland.

Suitable proteinaceous fluorescent labels also include, but are not limited to, green fluorescent protein, including a *Renilla, Ptilosarcus,* or *Aequorea* species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and *Renilla* (WO92/15673, WO95/07463, WO98/14605, WO98/26277, WO99/49019, U.S. Pat. Nos. 5,292,658; 5,418,155; 5,683,888; 5,741,668; 5,777,079; 5,804,387; 5,874,304; 5,876,995; 5,925,558).

Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191. The use of a modified leucine zipper that allows for stable trimerization of a heterologous protein fused thereto is described in Fanslow et al., 1994, Semin. Immunol. 6:267-78. In one approach, recombinant fusion proteins comprising a MSLN antibody fragment or derivative fused to a leucine zipper peptide are expressed in suitable host cells, and the soluble oligomeric MSLN antibody fragments or derivatives that form are recovered from the culture supernatant.

The antibody construct of the invention may also comprise additional domains, which are e.g. helpful in the isolation of the molecule or relate to an adapted pharmacokinetic profile of the molecule. Domains helpful for the isolation of an antibody construct may be selected from peptide motives or secondarily introduced moieties, which can be captured in an isolation method, e.g. an isolation column. Non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. StrepII-tag) and His-tag. All herein disclosed antibody constructs characterized by the identified CDRs are preferred to comprise a His-tag domain, which is generally known as a repeat of consecutive His residues in the amino acid sequence of a molecule, preferably of five, and more preferably of six His residues (hexahistidine). The His-tag may be located e.g. at the N- or C-terminus of the antibody construct, preferably it is located at the C-terminus. Most preferably, a hexa-histidine tag (HHHHHH) (SEQ ID NO:10) is linked via peptide bond to the C-terminus of the antibody construct according to the invention.

The first binding domain of the antibody construct of the present invention binds to human MSLN on the surface of a target cell. The preferred amino acid sequence of human MSLN is represented by NOs: 231, 232, and 233. The first binding domain according to the invention hence preferably binds to MSLN when it is expressed by naturally expressing cells or cell lines, and/or by cells or cell lines transformed or (stably/transiently) transfected with MSLN. In a preferred embodiment the first binding domain also binds to MSLN when MSLN is used as a "target" or "ligand" molecule in an in vitro binding assay such as BIAcore or Scatchard. The "target cell" can be any prokaryotic or eukaryotic cell expressing MSLN on its surface; preferably the target cell is a cell that is part of the human or animal body, such as a ovarian cancer cell, pancreatic cancer cell, mesothelioma cell, lung cancer cell, gastric cancer cell and triple negative breast cancer cell.

The affinity of the first binding domain for human MSLN is preferably ≤20 nM, more preferably ≤10 nM, even more preferably ≤5 nM, even more preferably ≤2 nM, even more preferably ≤1 nM, even more preferably ≤0.6 nM, even more preferably 50.5 nM, and most preferably ≤0.4 nM. The affinity can be measured for example in a BIAcore assay or in a Scatchard assay, e.g. as described in the Examples. Other methods of determining the affinity are also well-known to the skilled person; see e.g. appended Example 3.

Amino acid sequence modifications of the antibody constructs described herein are also contemplated. For example, it may be desirable to improve the binding affinity and/or other biological properties of the antibody construct. Amino acid sequence variants of the antibody constructs are prepared by introducing appropriate nucleotide changes into the antibody constructs nucleic acid, or by peptide synthesis. All of the below described amino acid sequence modifications should result in an antibody construct which still retains the desired biological activity (binding to MSLN and to CD3) of the unmodified parental molecule.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L); lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

Amino acid modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites.

For example, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs. Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intra-sequence insertions of single or multiple amino acid residues. An insertional variant of the antibody construct of the invention includes the fusion to the N-terminus or to the C-terminus of the antibody construct of an enzyme or the fusion to a polypeptide which increases the serum half-life of the antibody construct.

The sites of greatest interest for substitutional mutagenesis include the CDRs of the heavy and/or light chain, in particular the hypervanable regions, but FR alterations in the heavy and/or light chain are also contemplated. The substitutions are preferably conservative substitutions as described herein. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs), depending on the length of the CDR or FR. For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions are then refined by introducing further or other variants at, or for, the sites of substitution. Thus, while the site or region for introducing an amino acid sequence variation is predetermined, the nature of the mutation per se needs not to be predetermined. For example, to analyze or optimize the performance of a mutation at a given site, alanine scanning or random mutagenesis may be conducted at a target codon or region, and the expressed antibody construct variants are screened for the optimal combination of desired activity. Techniques for making substitution mutations at predetermined sites in the DNA having a known sequence are well known, for example, M13 primer mutagenesis and PCR mutagenesis. Screening of the mutants is done using assays of antigen binding activities, such as MSLN or CD3 binding.

Generally, if amino acids are substituted in one or more or all of the CDRs of the heavy and/or light chain, it is preferred that the then-obtained "substituted" sequence is at least 60% or 65%, more preferably 70% or 75%, even more preferably 80% or 85%, and particularly preferably 90% or 95% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to MSLN via the first binding domain and to CD3 or CD3 epsilon via the second binding domain and/or its CDRs have an identity to the then substituted sequence (at least 60% or 65%, more preferably 70% or 75%, even more preferably 80% or 85%, and particularly preferably 90% or 95% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino acid substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | Ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | Ala | ala |
| Ser (S) | Thr | thr |
| Thr (T) | Ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gin, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

For amino acid sequences, sequence identity and/or similarity is determined by using standard techniques known in the art, including, but not limited to, the local sequence identity algorithm of Smith and Waterman, 1981, Adv. Appl. Math. 2:482, the sequence identity alignment algorithm of Needleman and Wunsch, 1970, J. Mol. Biol. 48:443, the search for similarity method of Pearson and Lipman, 1988, Proc. Nat. Acad. Sci. U.S.A. 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, Nucl. Acid Res. 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, J. Mol. Evol. 35:351-360; the method is similar to that described by Higgins and Sharp, 1989, CABIOS 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, J. Mol. Biol. 215:403-410; Altschul et al., 1997, Nucleic Acids Res. 25:3389-3402; and Karin et al., 1993, Proc. Natl. Acad. Sci. U.S.A. 90:5873-5787. A particularly useful BLAST program is the WU-BLAST-2 program which was obtained from Altschul et al., 1996, Methods in Enzymology 266: 460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, Nucl. Acids Res. 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 60% to the sequences depicted herein, and more typically with preferably increasing homologies or identities of at least 65% or 70%, more preferably at least 75% or 80%, even more preferably at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antibody construct. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 60%, and more typically with preferably increasing homologies or identities of at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99%, and almost 100%. Thus, a "variant CDR" is one with the specified homology, similarity, or identity to the parent CDR of the invention, and shares biological function, including, but not limited to, at least 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

In one embodiment, the percentage of identity to human germline of the antibody constructs according to the invention is ≥70% or a 75%, more preferably ≥80% or ≥85%, even more preferably ≥90%, and most preferably ≥91%, ≥92%, ≥93%, ≥94%, ≥95% or even ≥96%. Identity to human antibody germline gene products is thought to be an important feature to reduce the risk of therapeutic proteins to elicit an immune response against the drug in the patient during treatment. Hwang & Foote ("Immunogenicity of engineered antibodies"; Methods 36 (2005) 3-10) demonstrate that the reduction of non-human portions of drug antibody constructs leads to a decrease of risk to induce anti-drug antibodies in the patients during treatment. By comparing an exhaustive number of clinically evaluated antibody drugs and the respective immunogenicity data, the trend is shown that humanization of the V-regions of antibodies makes the protein less immunogenic (average 5.1% of patients) than antibodies carrying unaltered non-human V regions (average 23.59% of patients). A higher degree of identity to human sequences is hence desirable for V-region based protein therapeutics in the form of antibody constructs. For this purpose of determining the germline identity, the V-regions of VL can be aligned with the amino acid sequences of human germline V segments and J segments (http://vbase.mrc-cpe.cam.ac.uk/) using Vector NTI software and the amino acid sequence calculated by dividing the identical amino acid residues by the total number of amino acid residues of the VL in percent. The same can be for the VH segments (http://vbase.mrc-cpe.cam.ac.uk/) with the exception that the VH CDR3 may be excluded due to its high diversity and a lack of existing human germline VH CDR3 alignment partners. Recombinant techniques can then be used to increase sequence identity to human antibody germline genes.

In a further embodiment, the bispecific antibody constructs of the present invention exhibit high monomer yields under standard research scale conditions, e.g., in a standard two-step purification process. Preferably the monomer yield of the antibody constructs according to the invention is ≥0.25 mg/L supernatant, more preferably ≥0.5 mg/L, even more preferably a 1 mg/L, and most preferably ≥3 mg/L supernatant.

Likewise, the yield of the dimeric antibody construct isoforms and hence the monomer percentage (i.e., monomer: (monomer+dimer)) of the antibody constructs can be determined. The productivity of monomeric and dimeric antibody constructs and the calculated monomer percentage can e.g. be obtained in the SEC purification step of culture supernatant from standardized research-scale production in roller bottles. In one embodiment, the monomer percentage of the antibody constructs is ≥80%, more preferably ≥85%, even more preferably ≥90%, and most preferably ≥95%.

In one embodiment, the antibody constructs have a preferred plasma stability (ratio of EC50 with plasma to EC50 w/o plasma) of ≤5 or ≤4, more preferably ≤3.5 or ≤3, even more preferably ≤2.5 or ≤2, and most preferably ≤1.5 or ≤1. The plasma stability of an antibody construct can be tested by incubation of the construct in human plasma at 37° C. for 24 hours followed by EC50 determination in a 51-chromium release cytotoxicity assay. The effector cells in the cytotoxicity assay can be stimulated enriched human CD8 positive T cells. Target cells can e.g. be CHO cells transfected with human MSLN. The effector to target cell (E:T) ratio can be chosen as 10:1. The human plasma pool used for this purpose is derived from the blood of healthy donors collected by EDTA coated syringes. Cellular components are removed by centrifugation and the upper plasma phase is collected and subsequently pooled. As control, antibody constructs are diluted immediately prior to the cytotoxicity assay in RPMI-1640 medium. The plasma stability is calculated as ratio of EC50 (after plasma incubation) to EC50 (control). See Example 6.

It is furthermore preferred that the monomer to dimer conversion of antibody constructs of the invention is low. The conversion can be measured under different conditions and analyzed by high performance size exclusion chromatography. See Example 9. For example, incubation of the monomeric isoforms of the antibody constructs can be carried out for 7 days at 37° C. and concentrations of e.g. 100 µg/ml or 250 µg/ml in an incubator. Under these conditions, it is preferred that the antibody constructs of the invention show a dimer percentage that is ≤5%, more preferably 0.4%, even more preferably ≤3%, even more preferably 0.2.5%, even more preferably 0.2%, even more preferably ≤1.5%, and most preferably ≤1% or ≤0.5% or even 0%.

It is also preferred that the bispecific antibody constructs of the present invention present with very low dimer conversion after a number of freeze/thaw cycles. For example, the antibody construct monomer is adjusted to a concentration of 250 µg/ml e.g. in generic formulation buffer and subjected to three freeze/thaw cycles (freezing at −80° C. for 30 min followed by thawing for 30 min at room temperature), followed by high performance SEC to determine the percentage of initially monomeric antibody construct, which had been converted into dimeric antibody construct. Preferably the dimer percentages of the bispecific antibody constructs are ≤5%, more preferably ≤0.4%, even more preferably ≤3%, even more preferably ≤2.5%, even more preferably ≤2%, even more preferably ≤1.5%, and most preferably ≤1% or even ≤0.5%, for example after three freeze/thaw cycles.

The bispecific antibody constructs of the present invention preferably show a favorable thermostability with aggregation temperatures≥45° C. or ≥50° C., more preferably ≥51° C., ≥52° C., ≥53° C. or ≥54° C., even more preferably ≥56° C. or ≥57° C., and most preferably ≥58° C. or ≥59° C. The thermostability parameter can be determined in terms of antibody aggregation temperature as follows: Antibody solution at a concentration 250 µg/ml is transferred into a single use cuvette and placed in a Dynamic Light Scattering (DLS) device. The sample is heated from 40° C. to 70° C. at a heating rate of 0.5° C./min with constant acquisition of the measured radius. Increase of radius indicating melting of the protein and aggregation is used to calculate the aggregation temperature of the antibody. See Example 10.

Alternatively, temperature melting curves can be determined by Differential Scanning Calorimetry (DSC) to determine intrinsic biophysical protein stabilities of the antibody constructs. These experiments are performed using a MicroCal LLC (Northampton, MA, U.S.A) VP-DSC device. The energy uptake of a sample containing an antibody construct is recorded from 20° C. to 90° C. compared to a sample containing only the formulation buffer. The antibody constructs are adjusted to a final concentration of 250 µg/ml e.g. in SEC running buffer. For recording of the respective melting curve, the overall sample temperature is increased stepwise. At each temperature T energy uptake of the sample and the formulation buffer reference is recorded. The difference in energy uptake Cp (kcal/mole/° C.) of the sample minus the reference is plotted against the respective temperature. The melting temperature is defined as the temperature at the first maximum of energy uptake.

The MSLN×CD3 bispecific antibody constructs of the invention are also envisaged to have a turbidity (as measured by OD340 after concentration of purified monomeric antibody construct to 2.5 mg/ml and over night incubation) of ≤0.2, preferably of ≤0.15, more preferably of ≤0.12, even more preferably of ≤0.1 or even ≥0.09, and most preferably of ≤0.08 or ≥0.07. See Example 11.

In a further embodiment the antibody construct according to the invention is stable at acidic pH. The more tolerant the antibody construct behaves at unphysiologic pH such as pH 5.5 (a pH which is required to run e.g. a cation exchange chromatography), the higher is the recovery of the antibody construct eluted from an ion exchange column relative to the total amount of loaded protein. Recovery of the antibody construct from an ion (e.g., cation) exchange column at pH 5.5 is preferably ≥30%, more preferably ≥40%, even preferably ≥50%, even more preferably ≥60%, even more preferably ≥70%, even more preferably ≥80%, even more preferably ≥90%, even more preferably ≥95%, and most preferably ≥99%. See Example 7.

It is furthermore envisaged that the bispecific antibody constructs of the present invention exhibit therapeutic efficacy or anti-tumor activity. This can e.g. be assessed in a study as disclosed in the following example of an advanced stage human tumor xenograft model:

On day 1 of the study, $5 \times 10^6$ cells of a human MSLN positive cancer cell line (e.g. OVCAR-8) are subcutaneously injected in the right dorsal flank of female NOD/SCID mice. When the mean tumor volume reaches about 100 mm$^3$, in vitro expanded human CD3 positive T cells are transplanted into the mice by injection of about $2 \times 10^7$ cells into the peritoneal cavity of the animals. Mice of vehicle control group 1 do not receive effector cells and are used as an untransplanted control for comparison with vehicle control group 2 (receiving effector cells) to monitor the impact of T cells alone on tumor growth. The antibody treatment starts when the mean tumor volume reaches about 200 mm$^3$. The mean tumor size of each treatment group on the day of treatment start should not be statistically different from any other group (analysis of variance). Mice are treated with 0.5 mg/kg/day of a MSLN×CD3 bispecifc antibody construct by intravenous bolus injection for about 15 to 20 days. Tumors are measured by caliper during the study and progress evaluated by intergroup comparison of tumor volumes (TV). The tumor growth inhibition TIC [%] is determined by calculating TV as T/C %=100×(median TV of analyzed group)/(median TV of control group 2).

The skilled person knows how to modify or adapt certain parameters of this study, such as the number of injected tumor cells, the site of injection, the number of transplanted human T cells, the amount of bispecific antibody constructs to be administered, and the timelines, while still arriving at a meaningful and reproducible result. Preferably, the tumor growth inhibition T/C [%] is ≤70 or ≤60, more preferably ≤50 or ≤40, even more preferably ≤30 or ≤20 and most preferably ≤10 or ≤5 or even ≤2.5.

The invention further provides a polynucleotide/nucleic acid molecule encoding an antibody construct of the invention.

A polynucleotide is a biopolymer composed of 13 or more nucleotide monomers covalently bonded in a chain. DNA (such as cDNA) and RNA (such as mRNA) are examples of polynucleotides with distinct biological function. Nucleotides are organic molecules that serve as the monomers or subunits of nucleic acid molecules like DNA or RNA. The nucleic acid molecule or polynucleotide can be double stranded and single stranded, linear and circular. It is preferably comprised in a vector which is preferably comprised in a host cell. Said host cell is, e.g. after transformation or transfection with the vector or the polynucleotide of the invention, capable of expressing the antibody construct. For that purpose the polynucleotide or nucleic acid molecule is operatively linked with control sequences.

The genetic code is the set of rules by which information encoded within genetic material (nucleic acids) is translated into proteins. Biological decoding in living cells is accomplished by the ribosome which links amino acids in an order specified by mRNA, using tRNA molecules to carry amino acids and to read the mRNA three nucleotides at a time. The code defines how sequences of these nucleotide triplets, called codons, specify which amino acid will be added next during protein synthesis. With some exceptions, a three-nucleotide codon in a nucleic acid sequence specifies a single amino acid. Because the vast majority of genes are encoded with exactly the same code, this particular code is often referred to as the canonical or standard genetic code. While the genetic code determines the protein sequence for a given coding region, other genomic regions can influence when and where these proteins are produced.

Furthermore, the invention provides a vector comprising a polynucleotide/nucleic acid molecule of the invention.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

"Transfection" is the process of deliberately introducing nucleic acid molecules or polynucleotides (including vectors) into target cells. The term is mostly used for non-viral methods in eukaryotic cells. Transduction is often used to describe virus-mediated transfer of nucleic acid molecules or polynucleotides. Transfection of animal cells typically involves opening transient pores or "holes" in the cell membrane, to allow the uptake of material. Transfection can be carried out using calcium phosphate, by electroporation, by cell squeezing or by mixing a cationic lipid with the material to produce liposomes, which fuse with the cell membrane and deposit their cargo inside.

The term "transformation" is used to describe non-viral transfer of nucleic acid molecules or polynucleotides (including vectors) into bacteria, and also into non-animal eukaryotic cells, including plant cells. Transformation is hence the genetic alteration of a bacterial or non-animal eukaryotic cell resulting from the direct uptake through the cell membrane(s) from its surroundings and subsequent incorporation of exogenous genetic material (nucleic acid molecules). Transformation can be effected by artificial means. For transformation to happen, cells or bacteria must be in a state of competence, which might occur as a time-limited response to environmental conditions such as starvation and cell density.

Moreover, the invention provides a host cell transformed or transfected with the polynucleotide/nucleic acid molecule or with the vector of the invention.

As used herein, the terms "host cell" or "recipient cell" are intended to include any individual cell or cell culture that can be or has/have been recipients of vectors, exogenous nucleic acid molecules, and polynucleotides encoding the antibody construct of the present invention; and/or recipients of the antibody construct itself. The introduction of the respective material into the cell is carried out by way of transformation, transfection and the like. The term "host cell" is also intended to include progeny or potential progeny of a single cell. Because certain modifications may occur in succeeding generations due to either natural, accidental, or deliberate mutation or due to environmental influences, such progeny may not, in fact, be completely identical (in morphology or in genomic or total DNA complement) to the parent cell, but is still included within the scope of the term as used herein. Suitable host cells include prokaryotic or eukaryotic cells, and also include but are not limited to bacteria, yeast cells, fungi cells, plant cells, and animal cells such as insect cells and mammalian cells, e.g., murine, rat, macaque or human.

The antibody construct of the invention can be produced in bacteria. After expression, the antibody construct of the invention is isolated from the *E. coli* cell paste in a soluble fraction and can be purified through, e.g., affinity chromatography and/or size exclusion. Final purification can be carried out similar to the process for purifying antibody expressed e.g., in CHO cells.

In addition to prokaryotes, eukaryotic microbes such as filamentous fungi or yeast are suitable cloning or expression hosts for the antibody construct of the invention. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe, Kluyveromyces* hosts such as

*K. lactis, K. fragilis* (ATCC 12424), *K. bulgaricus* (ATCC 16045), *K. wickeramii* (ATCC 24178), *K. waltii* (ATCC 56500), *K. drosophilarum* (ATCC 36906), *K. thermotolerans*, and *K. marxianus; yarrowia* (EP 402 226); *Pichia pastoris* (EP 183 070); *Candida; Trichoderma reesia* (EP 244 234); *Neurospora crassa; Schwanniomyces* such as *Schwanniomyces occidentalis*; and filamentous fungi such as *Neurospora, Penicillium, Tolypocladium*, and *Aspergillus* hosts such as *A. nidulans* and *A. niger*.

Suitable host cells for the expression of glycosylated antibody construct of the invention are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruit fly), and *Bombyx monri* have been identified. A variety of viral strains for transfection are publicly available, e.g., the L-1 variant of *Autographa californica* NPV and the Bm-5 strain of *Bombyx mori* NPV, and such viruses may be used as the virus herein according to the present invention, particularly for transfection of *Spodoptera frugiperda* cells.

Plant cell cultures of cotton, corn, potato, soybean, *petunia*, tomato, *Arabidopsis* and tobacco can also be used as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. (1982) 383: 44-68); MRC 5 cells; FS4 cells; and a human hepatoma line (Hep G2).

In a further embodiment the invention provides a process for the production of an antibody construct of the invention, said process comprising culturing a host cell of the invention under conditions allowing the expression of the antibody construct of the invention and recovering the produced antibody construct from the culture.

As used herein, the term "culturing" refers to the in vitro maintenance, differentiation, growth, proliferation and/or propagation of cells under suitable conditions in a medium. The term "expression" includes any step involved in the production of an antibody construct of the invention including, but not limited to, transcription, post-transcriptional modification, translation, post-translational modification, and secretion.

When using recombinant techniques, the antibody construct can be produced intracellularly, in the periplasmic space, or directly secreted into the medium. If the antibody construct is produced intracellulary, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be recovered or purified using, for example, hydroxylapatite chromatography, gel electrophoresis, dialysis, and affinity chromatography. Other techniques for protein purification such as fractionation on an ion-exchange column, ethanol precipitation, Reverse Phase HPLC, chromatography on silica, chromatography on heparin SEPHAROSE™ (a cross-linked beaded form of agarose), chromatography on an anion or cation exchange resin (such as a polyaspartic acid column), chromato-focusing, SDS-PAGE, and ammonium sulfate precipitation are also available depending on the antibody to be recovered. Where the antibody construct of the invention comprises a CH3 domain, the Bakerbond ABX resin (J.T. Baker, Phillipsburg, NJ) is useful for purification.

Affinity chromatography is a preferred purification technique. The matrix to which the affinity ligand is attached is most often agarose, but other matrices are available. Mechanically stable matrices such as controlled pore glass or poly (styrenedivinyl) benzene allow for faster flow rates and shorter processing times than can be achieved with agarose.

Moreover, the invention provides a pharmaceutical composition comprising an antibody construct of the invention or an antibody construct produced according to the process of the invention. It is preferred for the pharmaceutical composition of the invention that the homogeneity of the antibody construct is a ≥80%, more preferably ≥81%, ≥82%, ≥≥83%, ≥84%, or ≥85%, further preferably ≥86%, ≥87%, ≥88%, ≥89%, or ≥90%, still further preferably, ≥91%, ≥92%, ≥93%, ≥94%, or ≥95% and most preferably ≥96%, ≥97%, ≥98% or ≥99%.

As used herein, the term "pharmaceutical composition" relates to a composition which is suitable for administration to a patient, preferably a human patient. The particularly preferred pharmaceutical composition of this invention comprises one or a plurality of the antibody construct(s) of the invention, preferably in a therapeutically effective amount. Preferably, the pharmaceutical composition further comprises suitable formulations of one or more (pharmaceutically effective) carriers, stabilizers, excipients, diluents, solubilizers, surfactants, emulsifiers, preservatives and/or adjuvants. Acceptable constituents of the composition are preferably nontoxic to recipients at the dosages and concentrations employed. Pharmaceutical compositions of the invention include, but are not limited to, liquid, frozen, and lyophilized compositions.

The inventive compositions may comprise a pharmaceutically acceptable carrier. In general, as used herein, "pharmaceutically acceptable carrier" means any and all aqueous and non-aqueous solutions, sterile solutions, solvents, buffers, e.g. phosphate buffered saline (PBS) solutions, water, suspensions, emulsions, such as oil/water emulsions, various types of wetting agents, liposomes, dispersion media and coatings, which are compatible with pharmaceutical administration, in particular with parenteral administration. The use of such media and agents in pharmaceutical compositions is well known in the art, and the compositions comprising such carriers can be formulated by well-known conventional methods.

Certain embodiments provide pharmaceutical compositions comprising the antibody construct of the invention and further one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter.

In certain embodiments, the pharmaceutical composition may contain formulation materials for the purpose of modifying, maintaining or preserving, e.g., the pH, osmolarity, viscosity, clarity, color, isotonicity, odor, sterility, stability, rate of dissolution or release, adsorption or penetration of the composition (see, REMINGTON'S PHARMACEUTICAL SCIENCES, 18" Edition, (A.R. Genrmo, ed.), 1990, Mack Publishing Company). In such embodiments, suitable formulation materials may include, but are not limited to:
- amino acids such as glycine, alanine, glutamine, asparagine, threonine, proline, 2-phenylalanine, including charged amino acids, preferably lysine, lysine acetate, arginine, glutamate and/or histidine
- antimicrobials such as antibacterial and antifungal agents
- antioxidants such as ascorbic acid, methionine, sodium sulfite or sodium hydrogen-sulfite;
- buffers, buffer systems and buffering agents which are used to maintain the composition at physiological pH or at a slightly lower pH, typically within a pH range of from about 5 to about 8 or 9; examples of buffers are borate, bicarbonate, Tris-HCl, citrates, phosphates or other organic acids, succinate, phosphate, histidine and acetate; for example Tris buffer of about pH 7.0-8.5, or acetate buffer of about pH 4.0-5.5;
- non-aqueous solvents such as propylene glycol, polyethylene glycol, vegetable oils such as olive oil, and injectable organic esters such as ethyl oleate;
- aqueous carriers including water, alcoholic/aqueous solutions, emulsions or suspensions, including saline and buffered media;
- biodegradable polymers such as polyesters;
- bulking agents such as mannitol or glycine;
- chelating agents such as ethylenediamine tetraacetic acid (EDTA);
- isotonic and absorption delaying agents;
- complexing agents such as caffeine, polyvinylpyrrolidone, beta-cyclodextrin or hydroxypropyl-beta-cyclodextrin)
- fillers;
- monosaccharides; disaccharides; and other carbohydrates (such as glucose, mannose or dextrins); carbohydrates may be non-reducing sugars, preferably trehalose, sucrose, octasulfate, sorbitol or xylitol;
- (low molecular weight) proteins, polypeptides or proteinaceous carriers such as human or bovine serum albumin, gelatin or immunoglobulins, preferably of human origin;
- coloring and flavouring agents;
- sulfur containing reducing agents, such as glutathione, thioctic acid, sodium thioglycolate, thioglycerol, [alpha]-monothioglycerol, and sodium thio sulfate
- diluting agents;
- emulsifying agents;
- hydrophilic polymers such as polyvinylpyrrolidone)
- salt-forming counter-ions such as sodium;
- preservatives such as antimicrobials, anti-oxidants, chelating agents, inert gases and the like; examples are: benzalkonium chloride, benzoic acid, salicylic acid, thimerosal, phenethyl alcohol, methylparaben, propylparaben, chlorhexidine, sorbic acid or hydrogen peroxide);
- metal complexes such as Zn-protein complexes;
- solvents and co-solvents (such as glycerin, propylene glycol or polyethylene glycol);
- sugars and sugar alcohols, such as trehalose, sucrose, octasulfate, mannitol, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; and polyhydric sugar alcohols;
- suspending agents;
- surfactants or wetting agents such as pluronics, PEG, sorbitan esters, polysorbates such as polysorbate 20, polysorbate, triton, trometnamine, lecithin, cholesterol, tyloxapal; surfactants may be detergents, preferably with a molecular weight of >1.2 KD and/or a polyether, preferably with a molecular weight of >3 KD; non-limiting examples for preferred detergents are polysorbate 20, 40, 60, 80, and 85 (TWEEN® 20, TWEEN® 40, TWEEN® 60, TWEEN® 80 and TWEEN® 85; non-limiting examples for preferred polyethers are PEG 3000, PEG 3350, PEG 4000 and PEG 5000;
- stability enhancing agents such as sucrose or sorbitol;
- tonicity enhancing agents such as alkali metal halides, preferably sodium or potassium chloride, mannitol sorbitol;
- parenteral delivery vehicles including sodium chloride solution, Ringer's dextrose, dextrose and sodium chloride, lactated Ringer's, or fixed oils;
- intravenous delivery vehicles including fluid and nutrient replenishers, electrolyte replenishers (such as those based on Ringer's dextrose).

It is evident to those skilled in the art that the different constituents of the pharmaceutical composition (e.g., those listed above) can have different effects, for example, and amino acid can act as a buffer, a stabilizer and/or an antioxidant; mannitol can act as a bulking agent and/or a tonicity enhancing agent; sodium chloride can act as delivery vehicle and/or tonicity enhancing agent; etc.

It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antibody construct of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In certain embodiments, the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the antibody construct of the invention may be formulated as a lyophilizate using appropriate excipients such as sucrose.

When parenteral administration is contemplated, the therapeutic compositions for use in this invention may be provided in the form of a pyrogen-free, parenterally acceptable aqueous solution comprising the desired antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antibody construct.

Additional pharmaceutical compositions will be evident to those skilled in the art, including formulations involving the antibody construct of the invention in sustained- or controlled-delivery/release formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, polylactides (as disclosed in U.S. Pat. No. 3,773,919 and European Patent Application Publication No. EP 058481), copolymers of L-glutamic acid and gamma ethyl-L-glutamate (Sidman et al., 1983, Biopolymers 2:547-556), poly (2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(−)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949.

The antibody construct may also be entrapped in microcapsules prepared, for example, by coacervation techniques or by interfacial polymerization (for example, hydroxymethylcellulose or gelatine-microcapsules and poly (methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Another aspect of the invention includes self-buffering antibody construct of the invention formulations, which can be used as pharmaceutical compositions, as described in international patent application WO 06138181A2 (PCT/US2006/022599). A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution" in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions", Pharm Biotechnol. 13: 159-75 (2002), see particularly the parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention. As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic". Destabilizing solutes are referred to as "chaotropic". Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations. Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product. Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188. Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard. Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins. Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody construct are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody construct of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc. By "hepatic first-pass metabolism" is meant the propensity of a drug to be metabolized upon first contact with the liver, i.e. during its first pass through the liver. "Volume of distribution" means the degree of retention of a drug throughout the various compartments of the body, like e.g. intracellular and extracellular spaces, tissues and organs, etc. and the distribution of the drug within these compartments. "Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma. "Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific antibody constructs exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

One embodiment provides the antibody construct of the invention or the antibody construct produced according to the process of the invention for use in the prevention, treatment or amelioration of a tumor or cancer disease or of a metastatic cancer disease.

According to a preferred embodiment of the invention said tumor or cancer disease is a solid tumor disease.

The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

The term "amelioration" as used herein refers to any improvement of the disease state of a patient having a tumor or cancer or a metastatic cancer as specified herein below, by the administration of an antibody construct according to the invention to a subject in need thereof. Such an improvement may also be seen as a slowing or stopping of the p progression of the tumor or cancer or metastatic cancer of the patient. The term "prevention" as used herein means the avoidance of the occurrence or re-occurrence of a patient having a tumor or cancer or a metastatic cancer as specified herein below, by the administration of an antibody construct according to the invention to a subject in need thereof.

The term "disease" refers to any condition that would benefit from treatment with the antibody construct or the pharmaceutic composition described herein. This includes chronic and acute disorders or diseases including those pathological conditions that predispose the mammal to the disease in question.

A "neoplasm" is an abnormal growth of tissue, usually but not always forming a mass. When also forming a mass, it is commonly referred to as a "tumor". Neoplasms or tumors or can be benign, potentially malignant (pre-cancerous), or malignant. Malignant neoplasms are commonly called cancer. They usually invade and destroy the surrounding tissue and may form metastases, i.e., they spread to other parts, tissues or organs of the body. Hence, the term "metastatic cancer" encompasses metastases to other tissues or organs than the one of the original tumor. Lymphomas and leukemias are lymphoid neoplasms. For the purposes of the present invention, they are also encompassed by the terms "tumor" or "cancer".

In a preferred embodiment of the invention, the tumor or cancer disease is a solid tumor disease and the metastatic cancer disease can be derived from any of the foregoing.

Preferred tumor or cancer diseases in connection with this invention are selected from a group consisting of breast cancer, Carcinoid, cervical cancer, colorectal cancer, endometrial cancer, gastric cancer, head and neck cancer, mesothelioma, liver cancer, lung cancer, ovarian cancer, pancreatic cancer, prostate cancer, skin cancer, renal cancer and stomach cancer. More preferably, the tumor or cancer disease, which is preferably a solid tumor disease, can be selected from the group consisting of ovarian cancer, pancreatic cancer, mesothelioma, lung cancer, gastric cancer and triple negative breast cancer. The metastatic cancer disease can be derived from any of the foregoing.

The invention also provides a method for the treatment or amelioration of tumor or cancer disease or a metastatic cancer disease, comprising the step of administering to a subject in need thereof the antibody construct of the invention or the antibody construct produced according to the process of the invention.

The terms "subject in need" or those "in need of treatment" includes those already with the disorder, as well as those in which the disorder is to be prevented. The subject in need or "patient" includes human and other mammalian subjects that receive either prophylactic or therapeutic treatment.

The antibody construct of the invention will generally be designed for specific routes and methods of administration, for specific dosages and frequencies of administration, for specific treatments of specific diseases, with ranges of bio-availability and persistence, among other things. The materials of the composition are preferably formulated in concentrations that are acceptable for the site of administration.

Formulations and compositions thus may be designed in accordance with the invention for delivery by any suitable route of administration. In the context of the present invention, the routes of administration include, but are not limited to topical routes (such as epicutaneous, inhalational, nasal, ophthalmic, auricular/aural, vaginal, mucosal);

enteral routes (such as oral, gastrointestinal, sublingual, sublabial, buccal, rectal); and parenteral routes (such as intravenous, intraarterial, intraosseous, intramuscular, intracerebral, intracerebroventricular, epidural, intrathecal, subcutaneous, intraperitoneal, extra-amniotic, intraarticular, intracardiac, intradermal, intralesional, intrauterine, intravesical, intravitreal, transdermal, intranasal, transmucosal, intrasynovial, intraluminal).

The pharmaceutical compositions and the antibody construct of this invention are particularly useful for parenteral administration, e.g., subcutaneous or intravenous delivery, for example by injection such as bolus injection, or by infusion such as continuous infusion. Pharmaceutical compositions may be administered using a medical device. Examples of medical devices for administering pharmaceutical compositions are described in U.S. Pat. Nos. 4,475,196; 4,439,196; 4,447,224; 4,447,233; 4,486,194; 4,487,603; 4,596,556; 4,790,824; 4,941,880; 5,064,413; 5,312,335; 5,312,335; 5,383,851; and 5,399,163.

In particular, the present invention provides for an uninterrupted administration of the suitable composition. As a non-limiting example, uninterrupted or substantially uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of the antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may also be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

The compositions of the present invention can be administered to the subject at a suitable dose which can be determined e.g. by dose escalating studies by administration of increasing doses of the antibody construct of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts or doses effective for this use will depend on the condition to be treated (the indication), the delivered antibody construct, the therapeutic context and objectives, the severity of the disease, prior therapy, the patient's clinical history and response to the therapeutic agent, the route of administration, the size (body weight, body surface or organ size) and/or condition (the age and general health) of the patient, and the general state of the patient's own immune system. The proper dose can be adjusted according to the judgment of the attending physician such that it can be administered to the patient once or over a series of administrations, and in order to obtain the optimal therapeutic effect.

A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, an increase in frequency or duration of disease symptom-free periods or a prevention of impairment or disability due to the disease affliction. For treating MSLN-expressing tumors, a therapeutically effective amount of the antibody construct of the invention, e.g. an anti-MSLN/anti-CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

The pharmaceutical composition can be administered as a sole therapeutic or in combination with additional therapies such as anti-cancer therapies as needed, e.g. other proteinaceous and non-proteinaceous drugs. These drugs may be administered simultaneously with the composition comprising the antibody construct of the invention as defined herein or separately before or after administration of said antibody construct in timely defined intervals and doses.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

In a further embodiment, the invention provides a kit comprising an antibody construct of the invention, an antibody construct produced according to the process of the invention, a polynucleotide of the invention, a vector of the invention, and/or a host cell of the invention.

In the context of the present invention, the term "kit" means two or more components—one of which corresponding to the antibody construct, the pharmaceutical composition, the vector or the host cell of the invention—packaged together in a container, recipient or otherwise. A kit can hence be described as a set of products and/or utensils that are sufficient to achieve a certain goal, which can be marketed as a single unit.

The kit may comprise one or more recipients (such as vials, ampoules, containers, syringes, bottles, bags) of any appropriate shape, size and material (preferably waterproof, e.g. plastic or glass) containing the antibody construct or the pharmaceutical composition of the present invention in an appropriate dosage for administration (see above). The kit may additionally contain directions for use (e.g. in the form of a leaflet or instruction manual), means for administering the antibody construct of the present invention such as a syringe, pump, infuser or the like, means for reconstituting the antibody construct of the invention and/or means for diluting the antibody construct of the invention.

The invention also provides kits for a single-dose administration unit. The kit of the invention may also contain a first recipient comprising a dried/lyophilized antibody construct and a second recipient comprising an aqueous formulation. In certain embodiments of this invention, kits containing single-chambered and multi-chambered pre-filled syringes (e.g., liquid syringes and lyosyringes) are provided.

The Figures show:

FIGS. 1A and 1B:

Schematic representation of the human-mouse MSLN chimera. The MSLN chimera were generated with 6 distinct sequence stretch exchanges from human to mouse MSLN. Respective variants were expressed on the surface of CHO cell clones (E1-E6). See Example 1.

Figure 2A:
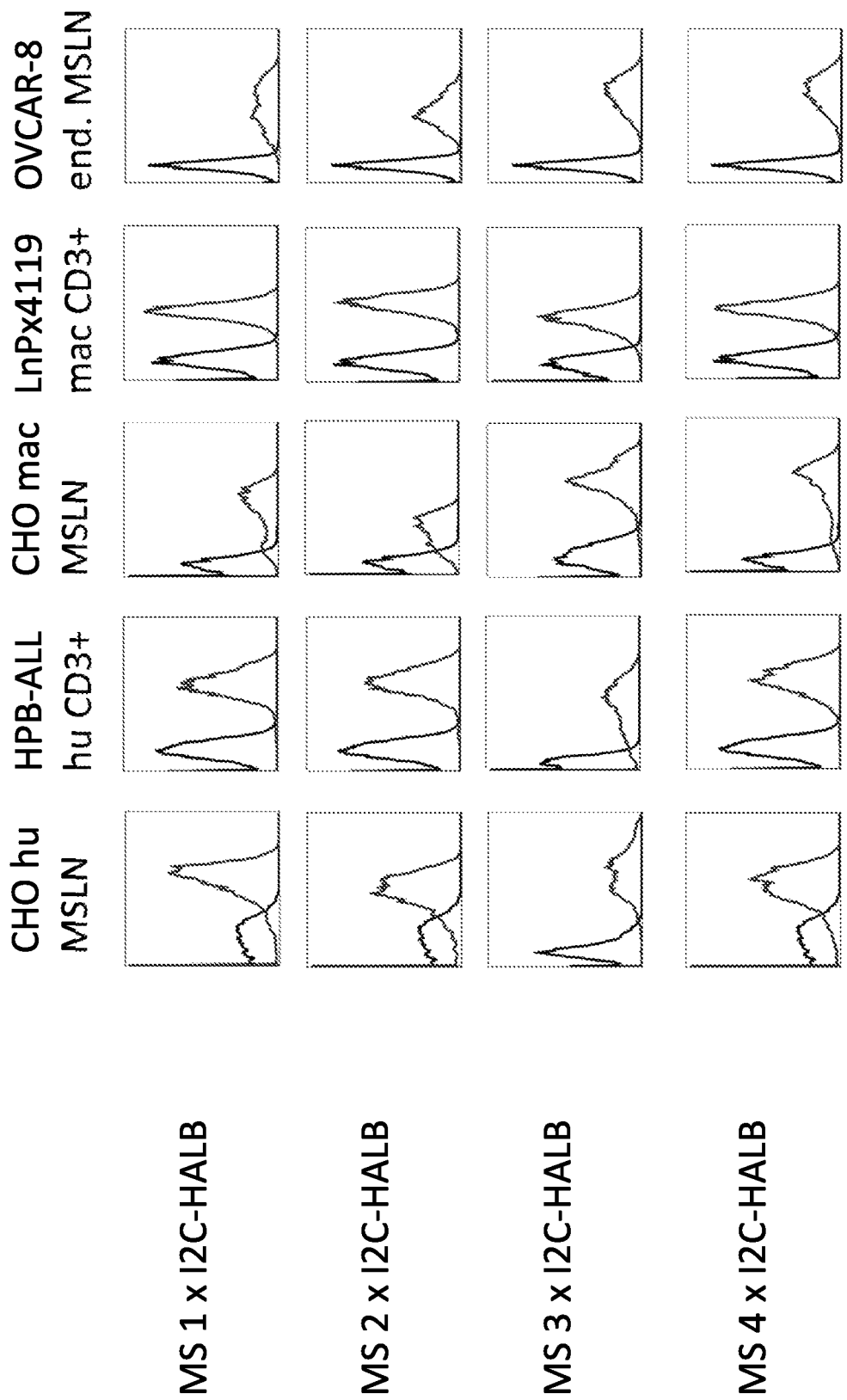
Figure 2B:
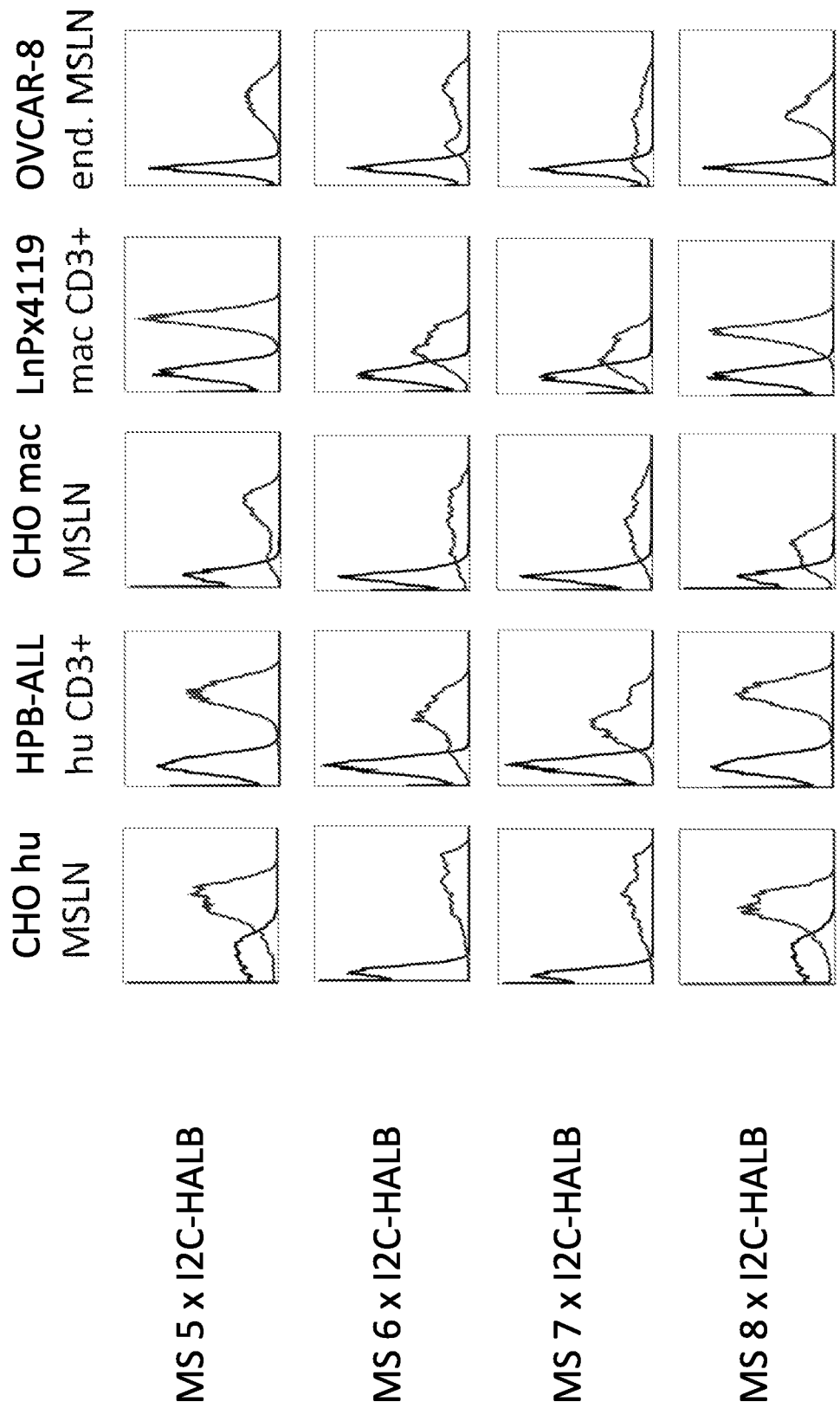

FIGS. 2A and 2B

Cross-Reactivity of anti-MSLN antibody constructs as detected by flow cytometry: binding to human and macaque MSLN and CD3. See Example 4.

Figure 3B:
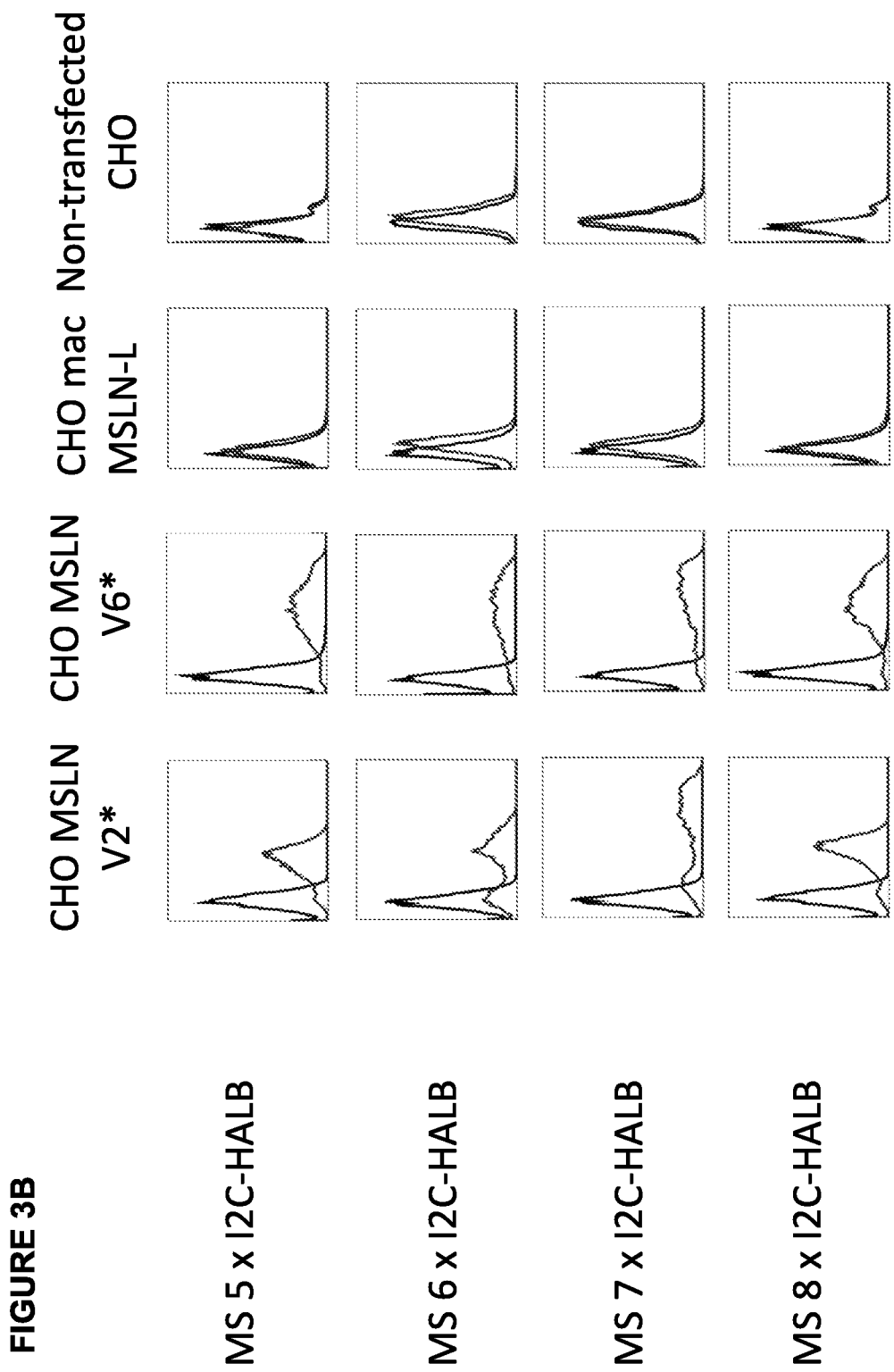

FIGS. 3A and 3B

Analysis of anti-MSLN antibody constructs by flow cytometry: binding to human variants v2 and v6. See Example 4.

FIG. 4

The potency of MSLN×CD3 bispecific antibody constructs in redirecting stimulated human CD8+ effector T cells against human MSLN-transfected CHO cells was measured in an 18 hour $^{51}$Cr release assay (Effector target ration 10:1).

FIG. 5

The potency of MSLN×CD3 bispecific antibody constructs in redirecting stimulated human CD8+ effector T cells against the MSLN positive OVCAR-8 was measured in an 18 hour $^{51}$Cr release assay (Effector target ration 10:1).

FIG. 6

The potency of MSLN×CD3 bispecific antibody constructs in redirecting the T cells in unstimulated human PBMC (CD14$^-$/CD56$^-$) against human MSLN-transfected CHO cells in the absence and presence of soluble MSLN was measured in a 48 hour FACS-based cytotoxicity assay (Effector target ration 10:1).

FIG. 7

The potency of MSLN×CD3 bispecific antibody constructs in redirecting the T cells in unstimulated human PBMC (CD14$^-$/CD56$^-$) against the MSLN-positive human cell line OVCAR-8 was measured in a 48 hour FACS-based cytotoxicity assay.

FIG. 8

Confirmation of the cross-reactive MSLN×CD3 bispecific antibody constructs are capable of redirecting macaque T cells against macaque MSLN-transfected CHO cells, 48 hour FACS-based cytotoxicity assay was performed with a macaque T cell line LnPx4119 as effector T cells (Effector target ration 10:1).

FIG. 9

Potency gap between the monomeric and the dimeric isoforms of MSLN×CD3 bispecific antibody constructs in redirecting the T cells in stimulated human CD8+ effector T cells against human MSLN-transfected CHO cells was measured in an 18 hour $^{51}$Cr release assay (Effector target ration 10:1).

FIG. 10

Stability of MSLN×CD3 bispecific antibody constructs after incubation for 96 hours in human plasma. 18-hour $^{51}$Cr based assay. Effector cells: stimulated enriched human CD8 T cells. Target cells: hu MSLN transfected CHO cells. Effector to target cell (E:T) ratio: 10:1. BITE protein as indicated.

Figure 11B:
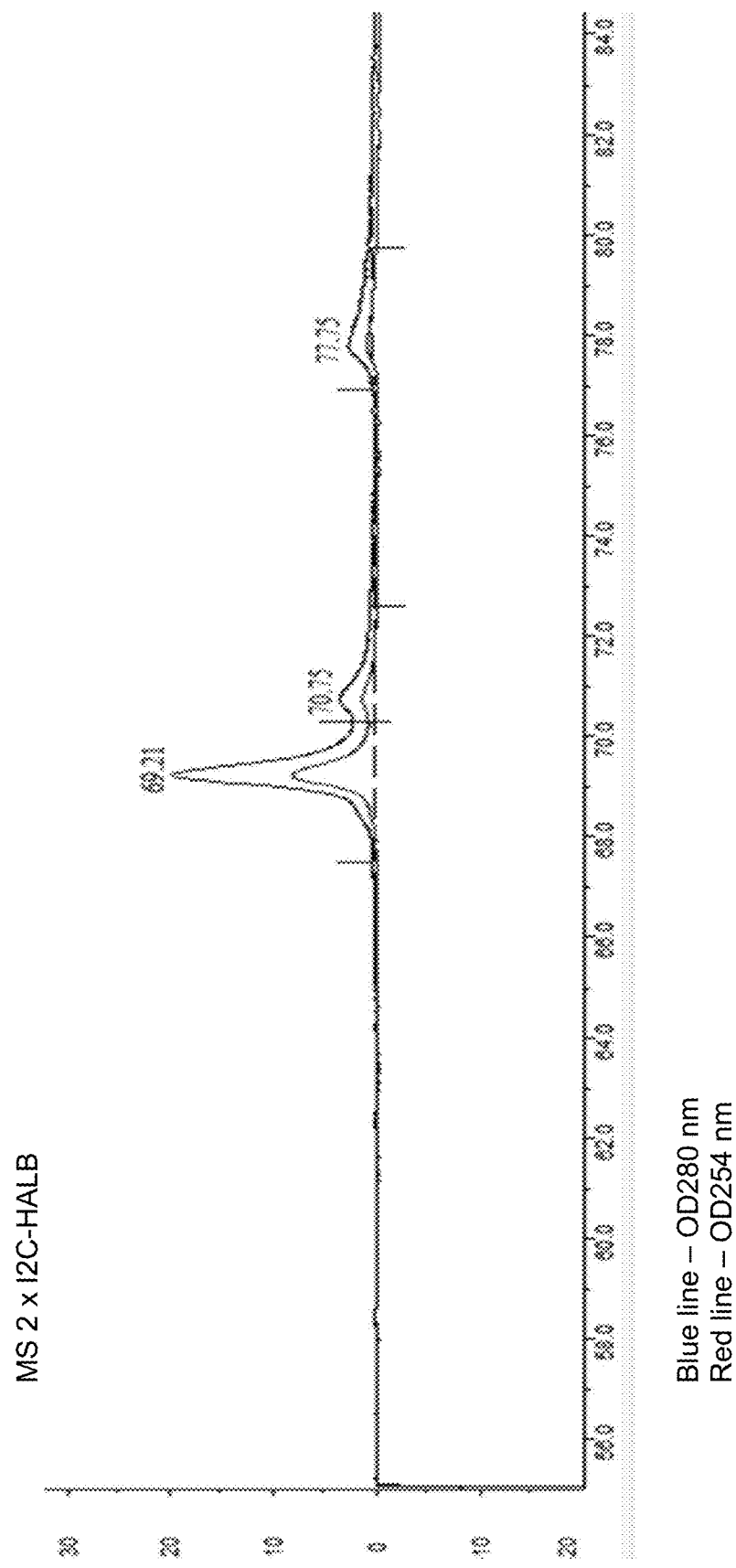

FIGS. 11A and 11B

Figure 12A:
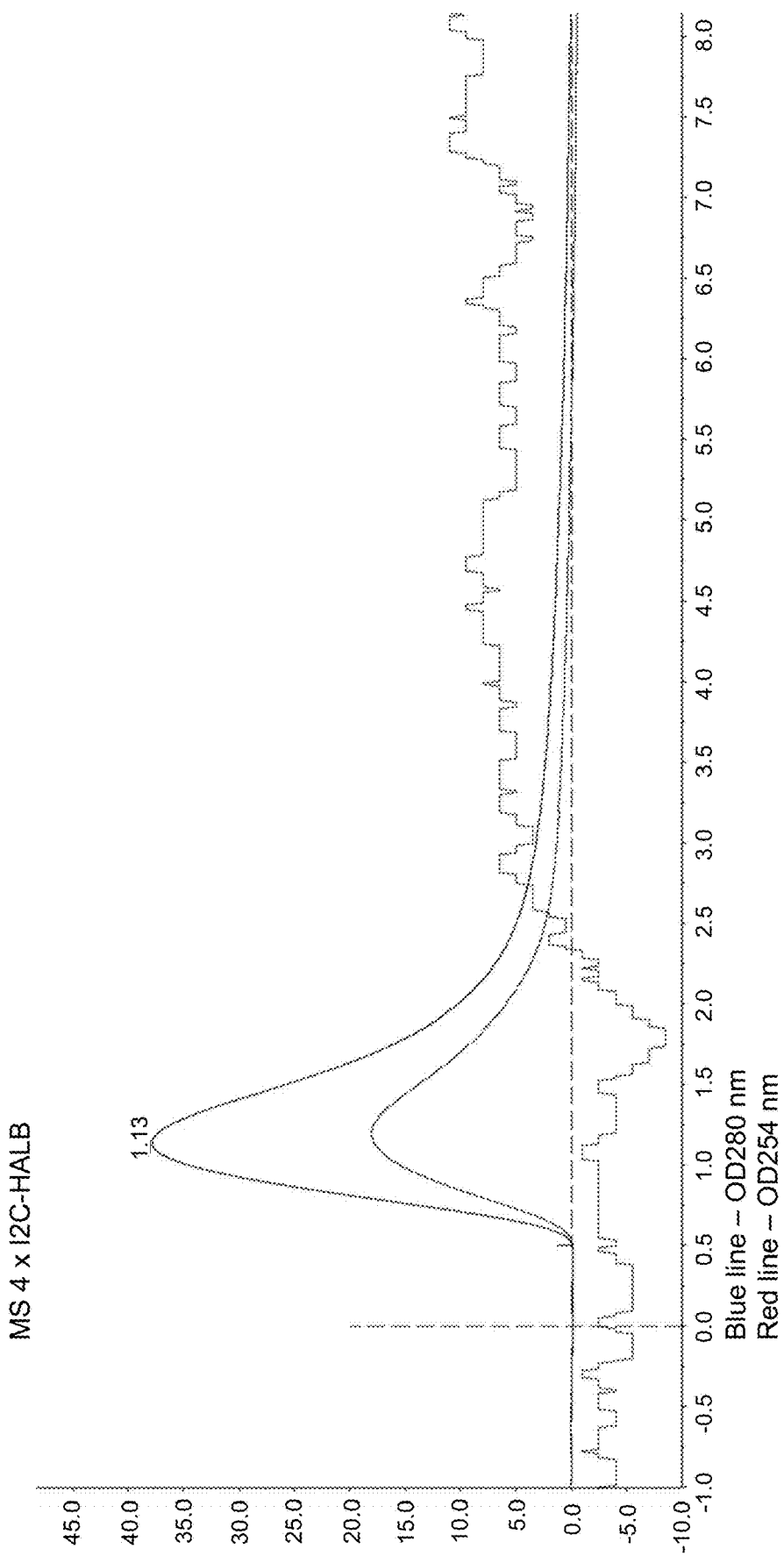
Figure 13A:
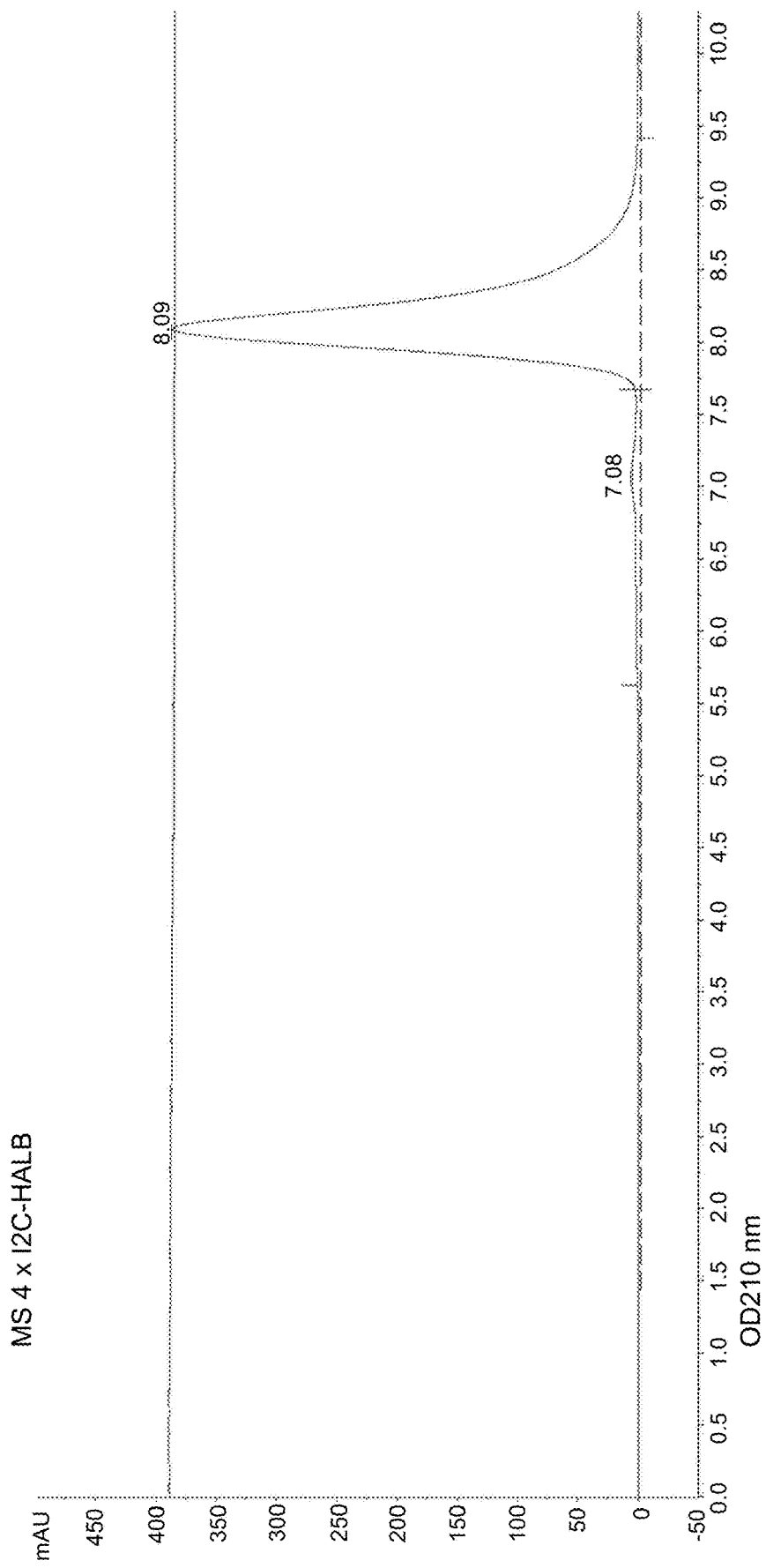
Figure 13B:
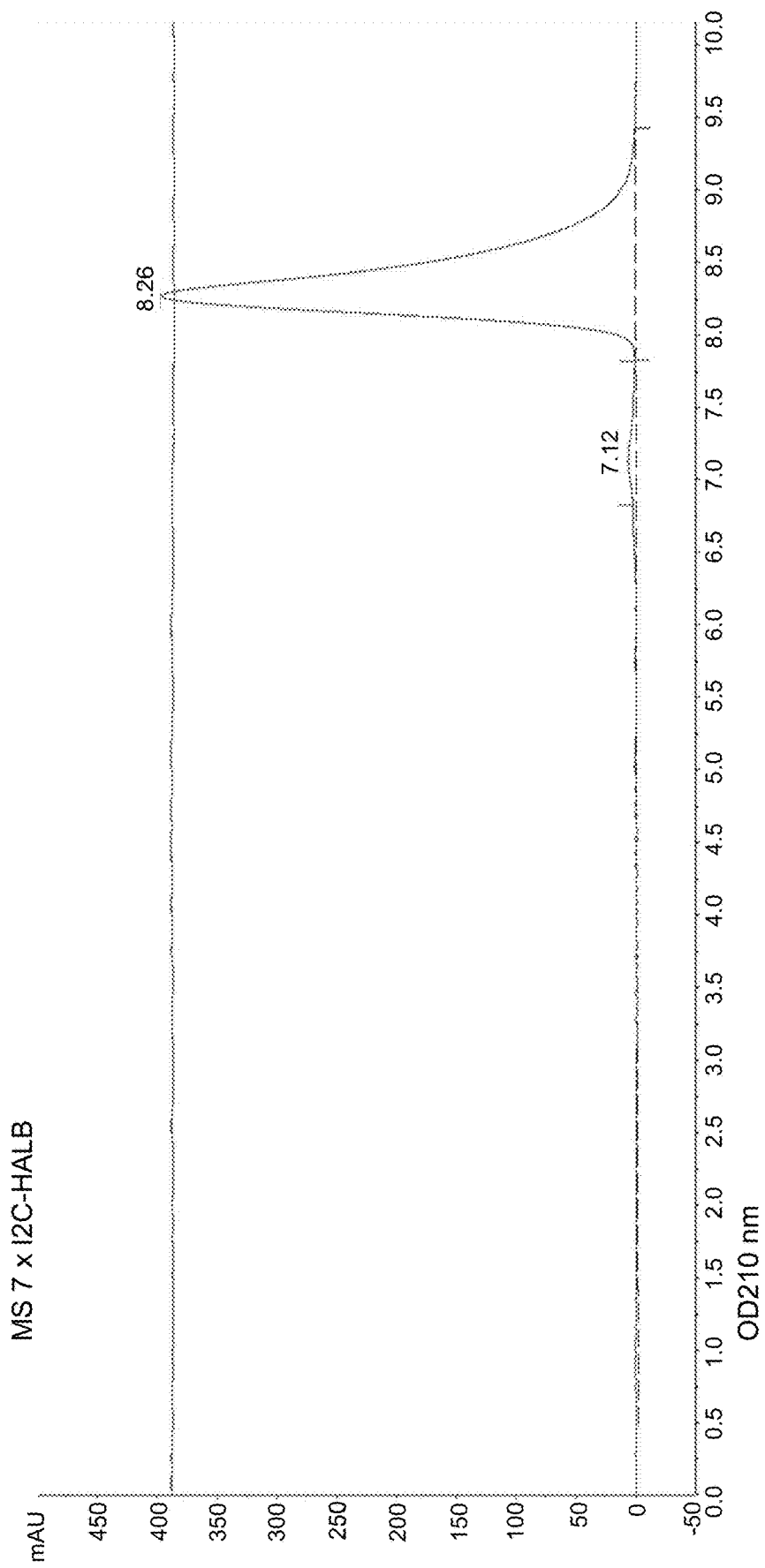

The protein homogeneity of the antibody constructs of the invention analyzed High Resolution Cation Exchange Chromatography CIEX FIGS. 12A and 12B The surface hydrophobicity of bispecific antibody constructs of the invention tested in Hydrophobic Interaction Chromatography HIC in flow-through mode FIGS. 13A and 13B Monomer to dimer conversion after three freeze/thaw cycles.

Figure 14A:
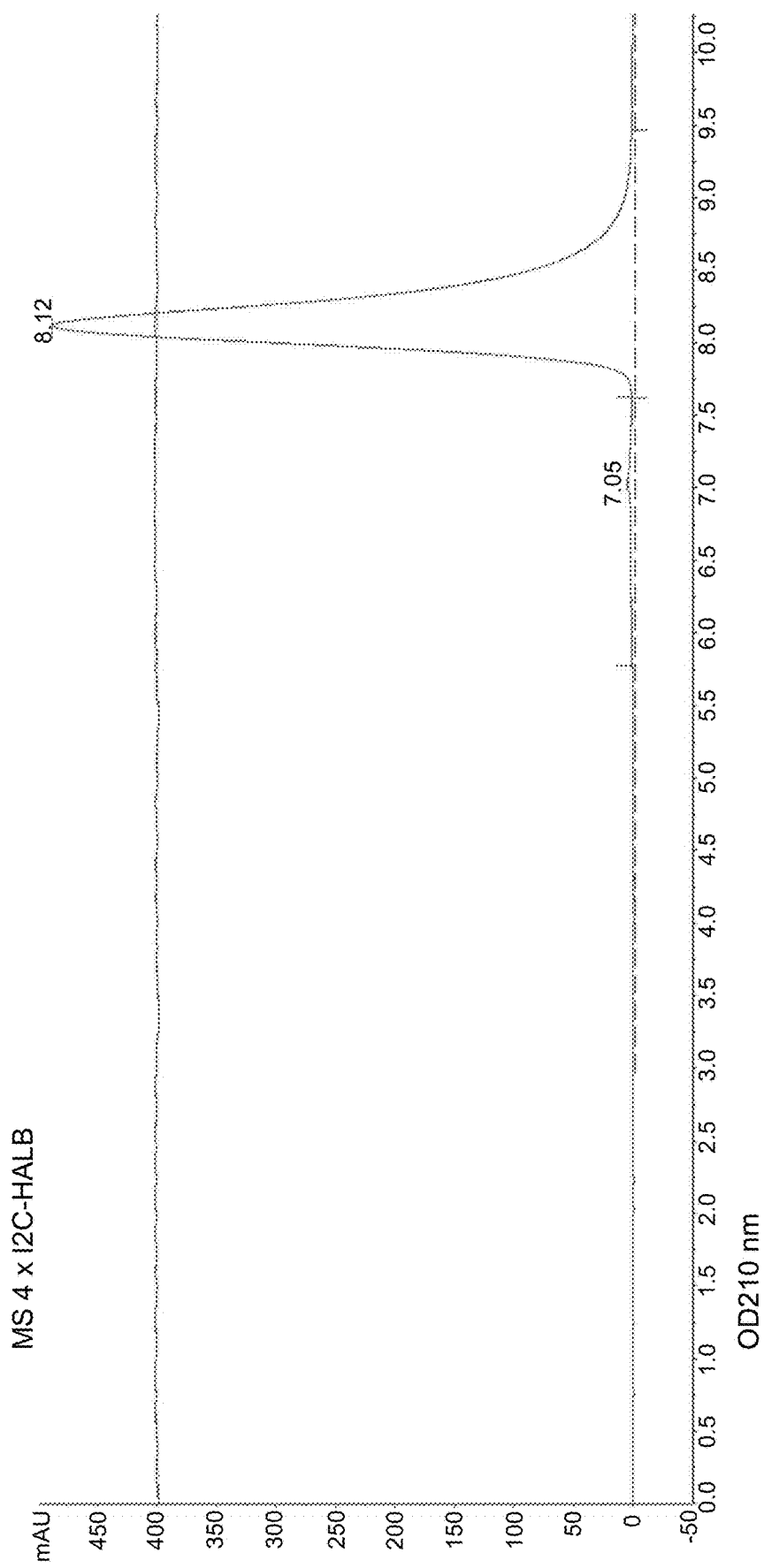

FIGS. 14A and 14B

Monomer to dimer conversion after 7 days of incubation at 250 µg/ml

FIGS. 15A and 15B

Evaluation of Target-independent T Cell Activation by Mesothelin (MS) HLE BiTE® antibody constructs. FIG. 15A: antibody construct of the invention in 48 h activation assay with human PBMC (3×); HLE BiTE® serial dilutions (start 20 nM; 1:5, 7×+blank); w/o or with FcR blocking [10 mg/mL huIgG (Kiovog, Baxter)]; FACS measurement of CD69 and CD25 [not shown] expression on CD4$^+$, CD8$^+$ T cells. FIG. 15B: Hetero-Fc antibody construct in 48 h activation assay with human PBMC and CD14$^+$/CD33$^+$ cell depleted PBMC (3×); HLE BiTE® serial dilutions (start 20 nM; 1:5, 7×+blank); FACS measurement of CD69 and CD25 [not shown] expression on CD4$^+$, CD8$^+$ T cells.

FIGS. 16A-16C

Evaluation of Target-independent T Cell Activation by CDH19 HLE BiTE® antibody constructs. FIG. 16A: antibody construct of the invention in 48 h activation assay with human PBMC (3×); HLE BiTE® serial dilutions (start 20 nM; 1:5, 7×+blank); w/o or with FcR blocking [10 mg/mL huIgG (Kiovog, Baxter)]; FACS measurement of CD69 and CD25 [not shown] expression on CD4+, CD8+ T cells. FIG. 16B: Hetero-Fc antibody construct in 48 h activation assay with human PBMC and CD14+/CD33+ cell depleted PBMC (3×); HLE BiTE® serial dilutions (start 20 nM; 1:5, 7×+blank); FACS measurement of CD69 and CD25 [not shown] expression on CD4+, CD8+ T cells. FIG. 16C: X-body construct in 48 h activation assay with human PBMC and CD14+/CD33+ cell depleted PBMC (3×); HLE BiTE® serial dilutions (start 20 nM; 1:5, 7×+blank); FACS measurement of CD69 and CD25 [not shown] expression on CD4+, CD8+ T cells.

FIG. 17

Complement C1q Binding of BiTE® Fc fusion antibody constructs. BiTE® Fc fusion antibody constructs (BiTE® single chain Fc (triangle), BiTE® hetero Fc (squares), canonical BiTE® (circle)) were coated on a Maxisorp plate (in dilution series), prior to incubation with pooled human serum and incubation with polyclonal anti human CC1q murine antibody, visualized by goat anti-mouse Fc-AP conjugate.

FIG. 18

Mean PK profiles of four pairs of BiTE®-HLE fusion proteins after single dose administration in cynomolgus monkeys. For reasons of comparability, serum concentrations were dose-normalized to 15 µg/kg and indicated in nmol.

FIG. 19

Mean PK profiles of five different BiTE® antibody constructs, each fused to a scFc half-life extending moiety. For reasons of comparability, serum concentrations were dose-normalized to 15 µg/kg and indicated in nmol.

EXAMPLES

The following examples illustrate the invention. These examples should not be construed as to limit the scope of this invention. The present invention is limited only by the claims.

Example 1

Generation of CHO Cells Expressing Wild Type and Chimeric MSLN

The MSLN antigen can be subdivided into six different sub-domains or regions that are defined, for the purposes of Examples 1 and 2. The aa sequence of those six sub-domains is depicted in SEQ ID NOs: 238-243.

The following molecules were generated; see also FIG. 1:
hu orl MSLN-E1 mu SEQ ID NO: 246
hu orl MSLN-E2 mu SEQ ID NO: 247
hu orl MSLN-E3 mu SEQ ID NO: 248
hu orl MSLN-E4 mu SEQ ID NO: 249
hu orl MSLN-E5 mu SEQ ID NO: 250
hu orl MSLN-E6 mu SEQ ID NO: 251
hu orl MSLN-full human SEQ ID NO: 231

For the generation of CHO cells expressing human, cynomolgus macaque ("cyno") and truncated human N-terminal V5 tagged MSLN, the respective coding sequences for human MSLN (SEQ ID NO: 231; see also GeneBank accession number NM_005823), cyno MSLN (SEQ ID NO: 234, see LMR C52457) and the six cimeric human/murine MSLN versions (see above) were cloned into a plasmid designated pEF-DHFR (pEF-DHFR is described in Raum et al. Cancer Immunol Immunother 50 (2001) 141-150). For cell surface expression of human and cyno MSLN the original signal peptide was used. All cloning procedures were carried out according to standard protocols (Sambrook, Molecular Cloning; A Laboratory Manual, 3rd edition, Cold Spring Harbour Laboratory Press, Cold Spring Harbour, New York (2001)). For each construct, a corresponding plasmid was transfected into DHFR deficient CHO cells for eukaryotic expression, as described by Kaufman R. J. (1990) Methods Enzymol. 185, 537-566.

The expression of human, chimeric and cyno MSLN on CHO cells was verified in a FACS assay using a monoclonal mouse IgG2b anti-human MSLN antibody. As negative control, cells were incubated with isotype control antibody instead of the first antibody. The samples were measured by flow cytometry.

Example 2

Epitope Mapping of Anti-MSLN Antibody Constructs

Cells transfected with human MSLN and with the chimeric human MSLN molecules (see Example 1) were stained with crude, undiluted periplasmic extract containing bispecific MSLN×CD3 antibody constructs (with the CD3 binding domain being denominated I2C) fused to a human albumin (variant 1), in PBS/1.5% FCS. Bound molecules were detected with an in-house mouse monoclonal anti-CD3 binding domain antibody (50 µl) followed by an anti-mouse IgG Fc-gamma-PE (1:100, 50 µl; Jackson Immunoresearch #115-116-071) All antibodies were diluted in PBS/1.5% FCS. As negative control, cells were incubated with PBS/2% FCS instead of the periplasmic extract. The samples were measured by flow cytometry.

The regions that were recognized by the respective MSLN binding domains are indicated in the sequence table (Table 2). Loss of the FACS signal in the respective chimeric MSLN constructs comprising the murine epitope cluster was the read out for the relevance of the respective cluster for the binding. In case the FACS signal was negatively impacted for more than one, respectively two, chimeric MSLN clone, it was concluded that both cluster are relevant.

TABLE 2

Mapping of the epitope clusters for MS-1 to MS-8

| Epitope cluster | Binder |
| --- | --- |
| E 1 + 2 | MS-1 |
| E 2 + 3 | MS-2 |
| E 2 + 3 | MS-3 |
| E 2 + 3 | MS-4 |
| E 2 + 3 | MS-5 |
| E 2 + 3 | MS-6 |
| E 4 | MS-7 |
| E 1 + 2 | MS-8 |

Example 3

Scatchard-Based Analysis of MSLN×CD3 Bispecific Antibody Construct Affinity to Human and Macaque MSLN on Target Antigen Positive Cells and Determination of the Interspecies Affinity Gap The affinities of MSLN×CD3 bispecific antibody constructs to CHO cells transfected with human or macaque MSLN were also determined by Scatchard analysis as the most reliable method for measuring potential affinity gaps between human and macaque MSLN. For the Scatchard analysis, saturation binding experiments are performed using a monovalent detection system to precisely determine monovalent binding of the MSLN×CD3 bispecific antibody constructs to the respective cell line.

$2 \times 10^4$ cells of the respective cell line (recombinantly human MSLN-expressing CHO cell line, recombinantly macaque MSLN-expressing CHO cell line) were incubated each with 50 µl of a triplet dilution series (twelve dilutions at 1:2) of the respective MSLN×CD3 bispecific antibody construct (until saturation is reached) starting at 10-20 nM followed by 16 h incubation at 4° C. under agitation and one residual washing step. Then, the cells were incubated for another hour with 30 µl of a CD3×ALEXA488 conjugate solution. After one washing step, the cells were resuspended in 150 µl FACS buffer containing 3.5% formaldehyde, incubated for further 15 min, centrifuged, resuspended in FACS buffer and analyzed using a FACS Cantoll machine and FACS Diva software. Data were generated from two independent sets of experiments, each using triplicates. Respective Scatchard analysis was calculated to extrapolate maximal binding (Bmax). The concentrations of MSLN×CD3 bispecific antibody constructs at half-maximal binding were determined reflecting the respective KDs. Values of triplicate measurements were plotted as hyperbolic curves and as S-shaped curves to demonstrate proper concentration ranges from minimal to optimal binding.

Values depicted in Table 3 were derived from two independent experiments per MSLN×CD3 bispecific antibody construct. Cell based Scatchard analysis confirmed that the MSLN×CD3 bispecific antibody constructs of the invention are subnanomolar in affinity to human MSLN and to mac MSLN and present with a small cyno/human interspecies affinity gap of around 1.

TABLE 3

Affinities (KD) of MSLN × CD3 bispecific antibody constructs as determined in cell based Scatchard analysis with the calculated affinity gap KD macaque MSLN/KD human MSLN. Antibody constructs were measured in two independent experiments, each using triplicates.

| BiTE antibody MS × I2C-HALB | Cell based affinity hu MSLN* [nM] | Cell based affinity mac MSLN* [nM] | Affinity gap $KD^{mac}/KD^{hu}$ MSLN |
|---|---|---|---|
| MS-1 | 1.25 ± 0.8 | 13.86 ± 2.9 | 11.08 |
| MS-8 | 4.68 ± 0.4 | 85.86 ± 16.7 | 18.35 |
| MS-2 | 1.40 ± 0.9 | 10.16 ± 3.5 | 7.28 |
| MS-3 | 0.74 ± 0.8 | 0.82 ± 0.5 | 1.12 |
| MS-4 | 0.91 ± 1.0 | 0.77 ± 0.7 | 0.85 |
| MS-5 | 0.39 ± 0.3 | 2.31 ± 3.7 | 5.91 |
| MS-6 | 0.60 ± 0.3 | 9.03 ± 3.7 | 15.04 |
| MS-7 | 1.06 ± 0.5 | 4.07 ± 1.0 | 3.86 |

Example 4

Bispecific Binding and Interspecies Cross-Reactivity

For confirmation of binding to human MSLN and CD3 and to cyno MSLN and CD3, bispecific antibody constructs of the invention were tested by flow cytometry using
CHO cells transfected with human MSLN, with human MSLN isoform (NM_013404=SEQ ID NO:232 and AY743922=SEQ ID NO:233), and with macaque MSLN, respectively,
the human MSLN positive human cell line OVCAR-8,
CD3-expressing human T cell leukemia cell line HPB-all (DSMZ, Braunschweig, ACC483), and
the cynomolgus CD3-expressing T cell line LnPx 4119

For flow cytometry 200,000 cells of the respective cell lines were incubated for 60 min at 4° C. with 50 µl of purified bispecific antibody construct at a concentration of 5 µg/ml. The cells were washed twice in PBS/2% FCS and then incubated with an in-house mouse antibody (2 µg/ml) specific for the CD3 binding part of the bispecific antibody constructs for 30 min at 4° C. After washing, bound mouse antibodies were detected with a goat anti-mouse Fcγ-PE (1:100) for 30 min at 4° C. Samples were measured by flow cytometry. Non-transfected CHO cells were used as negative control.

The results are shown in FIGS. 2A and 2B and FIGS. 3A and 3B. The MSLN×CD3 bispecific antibody constructs of the invention stained CHO cells transfected with human MSLN, the artificial MSLN isoform and with cyno MSLN, and they also stained the human MSLN positive human cell line OVCAR-8 (natural expresser). Human and cyno T cell lines expressing CD3 were also recognized by the bispecific antibody constructs. Moreover, there was no staining of the negative control cells (non-transfected CHO).

Example 5

Cytotoxic Activity

Figure 5:
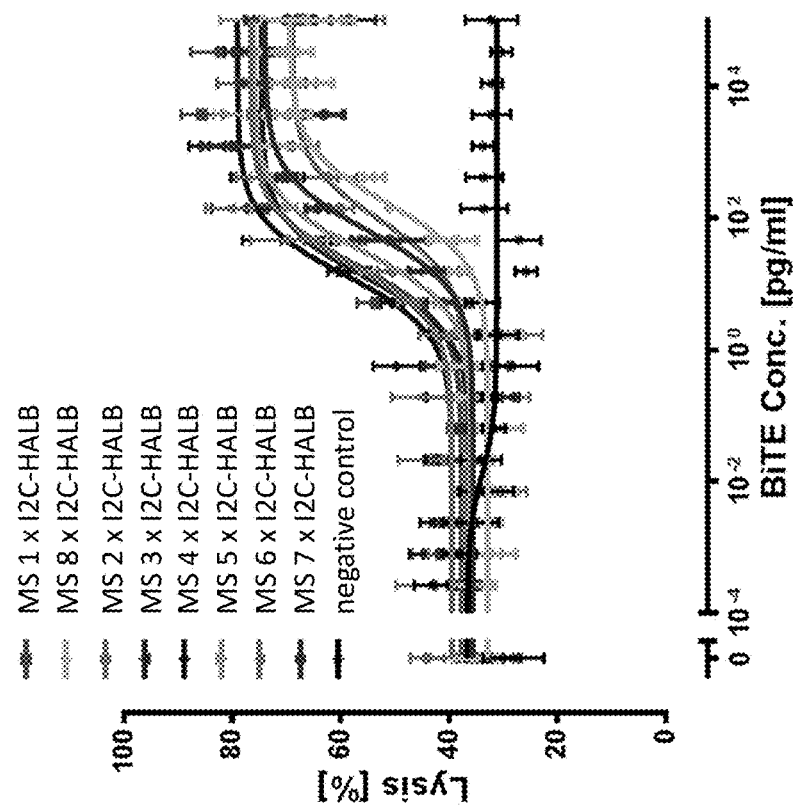
Figure 4:
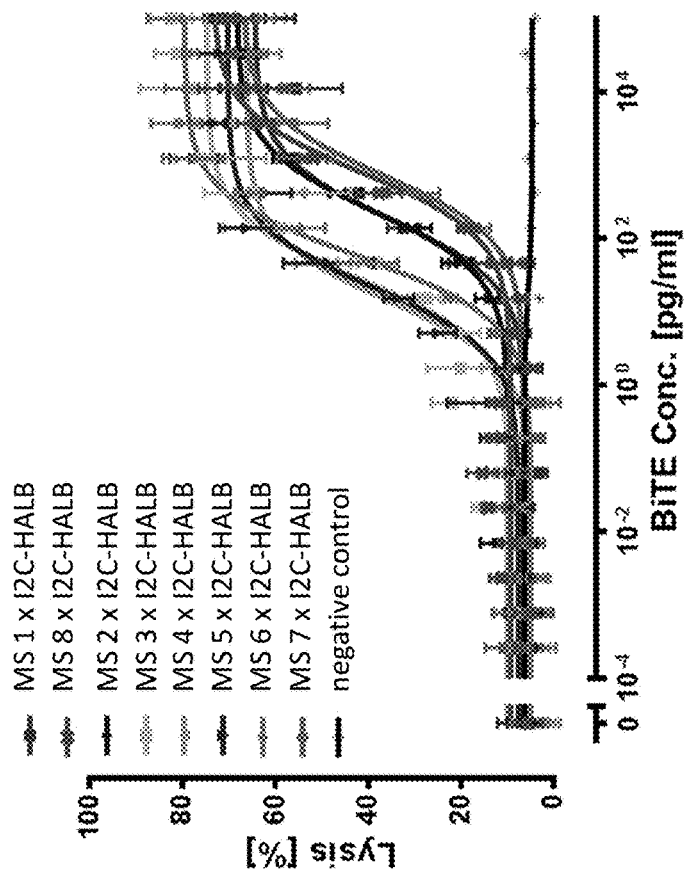
Figure 6:
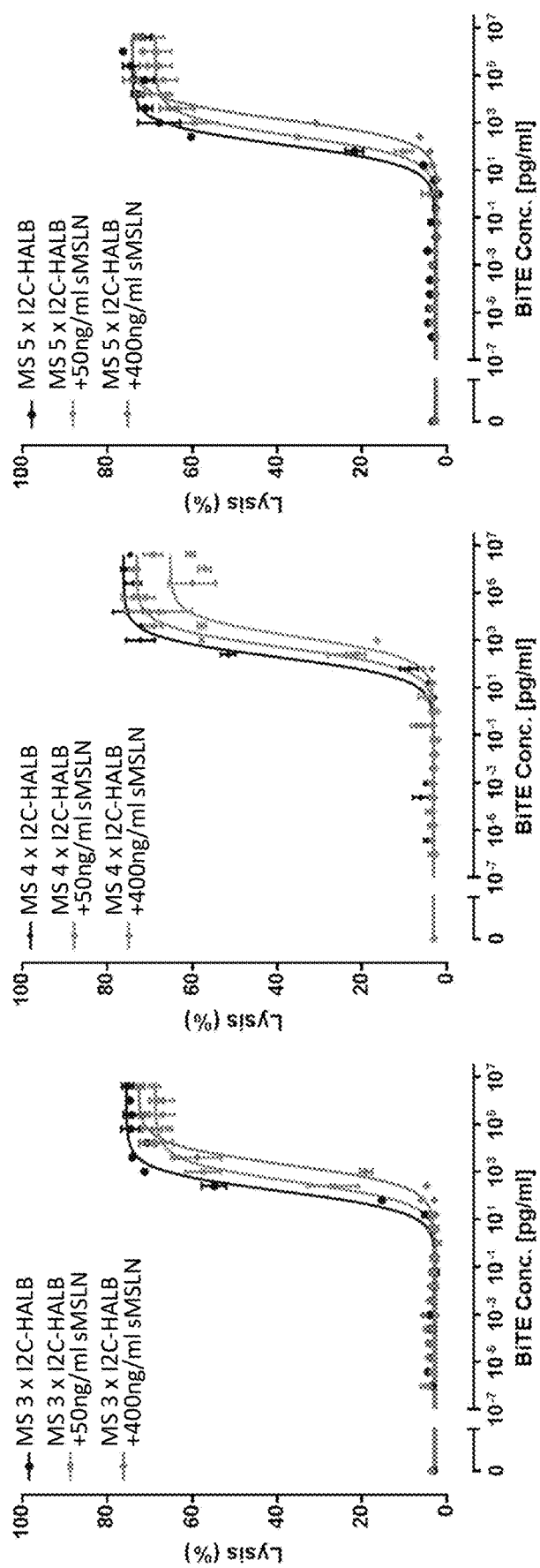
Figure 8:
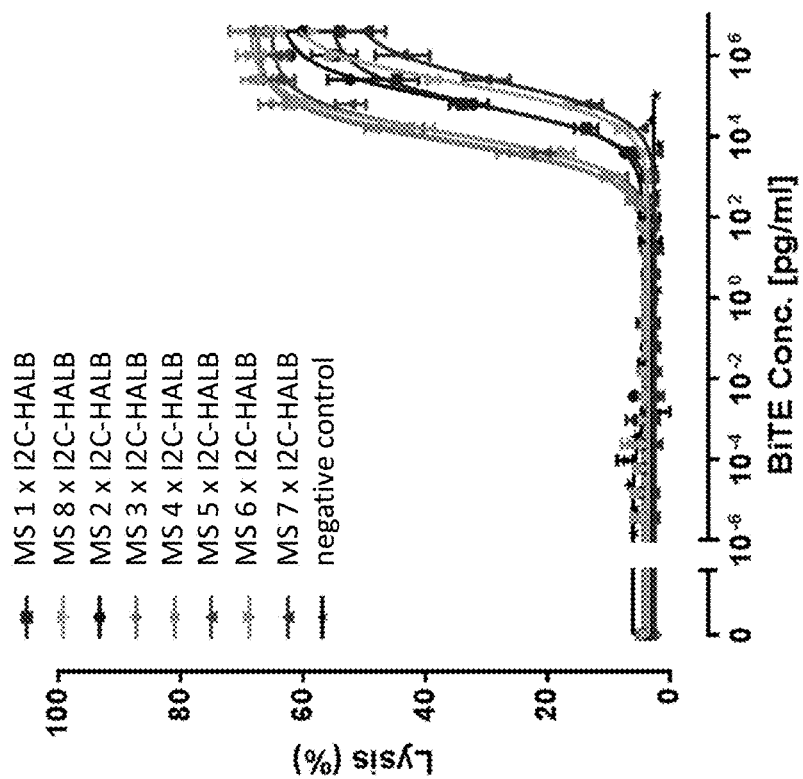
Figure 7:
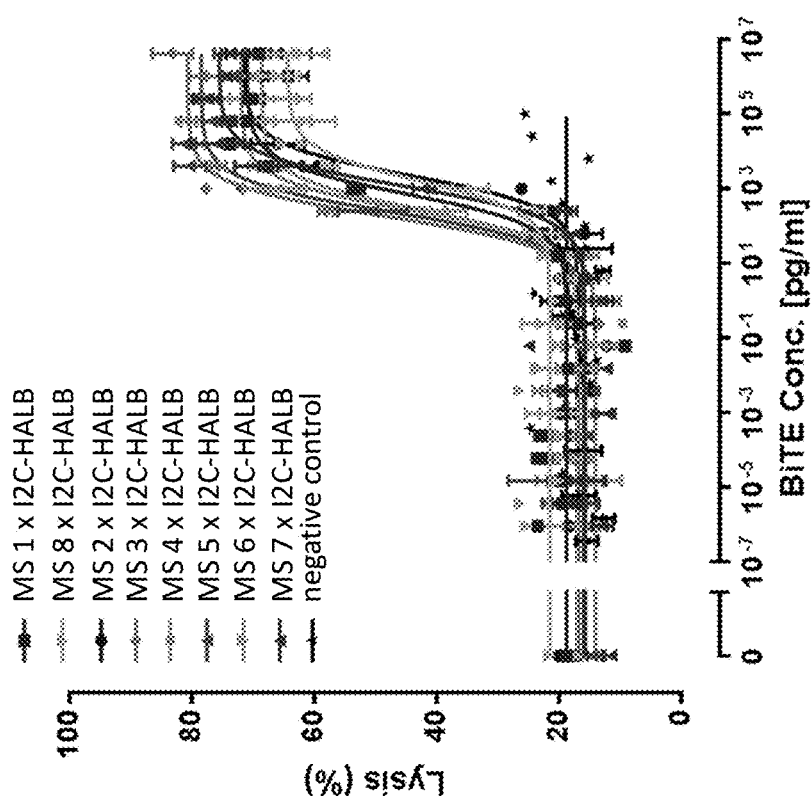
Figure 9:
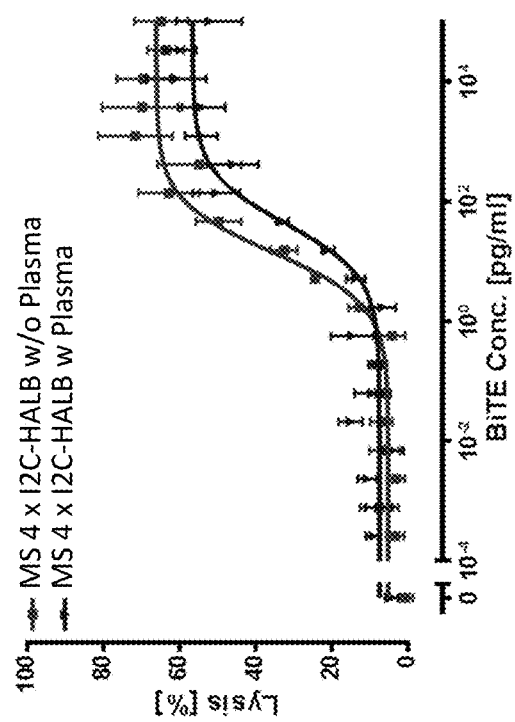
Figure 10:
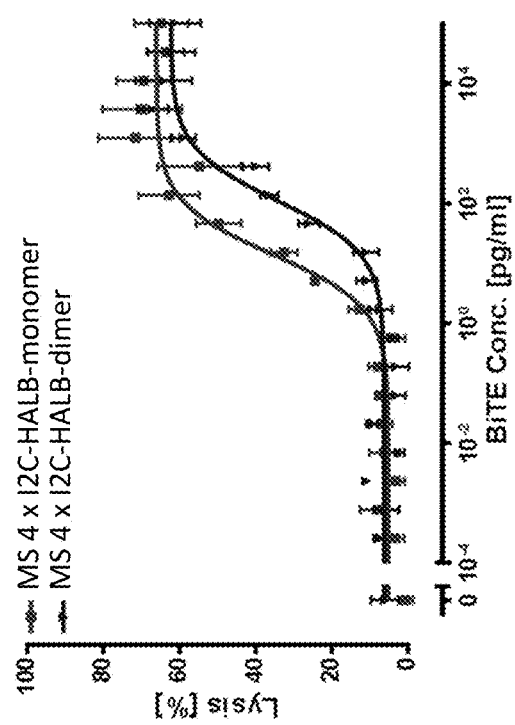

The potency of MSLN×CD3 bispecific antibody constructs of the invention in redirecting effector T cells against MSLN-expressing target cells was analyzed in five in vitro cytotoxicity assays:
- The potency of MSLN×CD3 bispecific antibody constructs in redirecting stimulated human CD8+ effector T cells against human MSLN-transfected CHO cells was measured in an 18 hour $^{51}$Cr release assay (Effector target ration 10:1). FIG. 4 and Table 4
- The potency of MSLN×CD3 bispecific antibody constructs in redirecting stimulated human CD8+ effector T cells against the MSLN positive cell line OVCAR-8 was measured in an 18 hour $^{51}$Cr release assay (Effector target ration 10:1). FIG. 5 Table 5
- The potency of MSLN×CD3 bispecific antibody constructs in redirecting the T cells in unstimulated human PBMC (CD14−/CD56−) against human MSLN-transfected CHO cells in the absence and presence of soluble MSLN was measured in a 48 hour FACS-based cytotoxicity assay (Effector target ration 10:1). FIG. 6 and Table 6
- The potency of MSLN×CD3 bispecific antibody constructs in redirecting the T cells in unstimulated human PBMC (CD14−/CD56−) against the MSLN-positive human cell line OVCAR-8 was measured in a 48 hour FACS-based cytotoxicity assay. FIG. 7
- For confirmation that the cross-reactive MSLN×CD3 bispecific antibody constructs are capable of redirecting macaque T cells against macaque MSLN-transfected CHO cells, a 48 hour FACS-based cytotoxicity assay was performed with a macaque T cell line LnPx4119 as effector T cells (Effector target ration 10:1). FIG. 8
- Potency gap between the monomeric and the dimeric isoforms of MSLN×CD3 bispecific antibody constructs in redirecting the T cells in stimulated human CD8+ effector T cells against human MSLN-transfected CHO cells was measured in an 18 hour $^{51}$Cr release assay (Effector target ration 10:1). FIG. 9

Example 5.1

Chromium Release Assay with Stimulated Human T Cells

Stimulated T cells enriched for CD8+ T cells were obtained as described in the following. A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5×10$^7$ human PBMC were added to the precoated petri dish in 120 ml of RPMI 1640 with stabilized glutamine/10% FCS/IL-2 20 U/ml (Pro-leukin®, Chiron) and stimulated for 2 days. On the third day, the cells were collected and washed once with RPMI 1640. IL-2 was added to a final concentration of 20 U/ml and the cells were cultured again for one day in the same cell culture medium as above. CD8$^+$ cytotoxic T lymphocytes (CTLs) were enriched by depletion of CD4$^+$ T cells and CD56$^+$ NK cells using Dynal-Beads according to the manufacturer's protocol.

Cyno MSLN- or human MSLN-transfected CHO target cells were washed twice with PBS and labeled with 11.1 MBq $^{51}$Cr in a final volume of 100 µl RPMI with 50% FCS for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.01-1 µg/ml of purified bispecific antibody construct and threefold dilutions thereof were used. Incubation time for the assay was 18 hours. Cytotoxicity was determined as relative values of released chromium in the supernatant relative to the difference of maximum lysis (addition of TRITON™ X-100, a nonionic surfactant that has a hydrophilic polyethylene oxide chain and an aromatic hydrocarbon lipophilic or hydrophobic group) and spontaneous lysis (without effector cells). All measurements were carried out in quadruplicates. Measurement of chromium activity in the supernatants was performed in a Wizard 3" gamma counter (Perkin Elmer Life Sciences GmbH, Köln, Germany). Analysis of the results was carried out with Prism 5 for Windows (version 5.0, GraphPad Software Inc., San Diego, California, USA). EC50 values calculated by the analysis program from the sigmoidal dose response curves were used for comparison of cytotoxic activity.

Example 5.2

Potency of Redirecting Stimulated Human Effector T Cells Against Human MSLN-Transfected CHO Cells The cytotoxic activity of MSLN×CD3 bispecific antibody constructs according to the invention was analyzed in a 51-chromium ($^{51}$Cr) release cytotoxicity assay using CHO cells transfected with human MSLN as target cells, and stimulated human CD8+ T cells as effector cells. The experiment was carried out as described in Example 8.1.

The results are shown in Table 4. The MSLN×CD3 bispecific antibody constructs showed very potent cytotoxic activity against human MSLN transfected CHO cells in the 1-digit picomolar range.

TABLE 4

EC50 values [pM] of MSLN × CD3 bispecific antibody constructs analyzed in a 51-chromium ($^{51}$Cr) release cytotoxicity assay using CHO cells transfected with human MSLN as target cells, and stimulated human CD8 T cells as effector cells.

| BiTE × I2C-HALB | EC50 [pM] |
| --- | --- |
| MS 1 | 1.5 |
| MS 8 | 6.5 |
| MS 2 | 2.0 |
| MS 3 | 0.2 |
| MS 4 | 0.1 |
| MS 5 | 0.2 |
| MS 6 | 0.5 |
| MS 7 | 6.0 |

Example 5.3

Potency of Redirecting Stimulated Human Effector T Cells Against the MSLN Positive Human Cell Line OVCAR-8

The cytotoxic activity of MSLN×CD3 bispecific antibody constructs was analyzed in a 51-chromium ($^{51}$Cr) release cytotoxicity assay using the MSLN-positive human cell line OVCAR-8 as source of target cells, and stimulated human CD8+ T cells as effector cells. The assay was carried out as described in Example 8.1.

In accordance with the results of the 51-chromium release assays with stimulated enriched human CD8+ T lymphocytes as effector cells and human MSLN-transfected CHO cells as target cells, MSLN×CD3 bispecific antibody constructs of the present invention are also potent in cytotoxic activity against natural expresser target cells (see Table 5).

TABLE 5

EC50 values [pM] of MSLN × CD3 bispecific antibody constructs analyzed in an 18-hour 51-chromium ($^{51}$Cr) release cytotoxicity assay with the MSLN-positive human cell line OVCAR-8 as source of target cells, and stimulated enriched human CD8 T cells as effector cells.

| BiTE × I2C-HALB | EC50 [pM] |
| --- | --- |
| MS 1 | 0.2 |
| MS 8 | 1.3 |
| MS 2 | 0.8 |
| MS 3 | 0.1 |
| MS 4 | 0.1 |
| MS 5 | 0.3 |
| MS 6 | 0.2 |
| MS 7 | 0.5 |

Example 5.4

FACS-Based Cytotoxicity Assay with Unstimulated Human PBMC Isolation of Effector Cells Human peripheral blood mononuclear cells (PBMC) were prepared by Ficoll density gradient centrifugation from enriched lymphocyte preparations (buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM $NH_4Cl$, 10 mM $KHCO_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).

Depletion of CD14 and CD56+ Cells

For depletion of CD14+ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/$10^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 Micro-Beads (20 µL/$10^7$ cells) were added and incubated for 15 min at 4-8° C. The cells were washed with MACS isolation buffer (1-2 mL/$10^7$ cells). After centrifugation (see above), supernatant was discarded and cells resuspended in MACS isolation buffer (500 µL/$10^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.

Target Cell Labeling

For the analysis of cell lysis in flow cytometry assays, the fluorescent membrane dye $DiOC_{18}$ (DiO) (Molecular Probes, #V22886) was used to label human MSLN- or macaque MSLN-transfected CHO cells as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to 1.25×$10^5$ cells/mL. The vitality of cells was determined using 0.5% (v/v) isotonic EosinG solution (Roth, #45380).

Flow Cytometry Based Analysis

This assay was designed to quantify the lysis of cyno or human MSLN-transfected CHO cells in the presence of serial dilutions of MSLN bispecific antibody constructs. Equal volumes of DiO-labeled target cells and effector cells (i.e., PBMC w/o CD14+ cells) were mixed, resulting in an E:T cell ratio of 10:1. 160 µl of this suspension were transferred to each well of a 96-well plate. 40 µL of serial dilutions of the MSLN×CD3 bispecific antibody constructs and a negative control bispecific (a CD3-based bispecific antibody construct recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto™ II instrument and analyzed by FACSDiva™ software (both from Becton Dickinson). Target cells were identified as DiD-positive cells. PI-negative target cells were classified as living target cells. Percentage of cytotoxicity was calculated according to the following formula:

$$\text{Cytotoxicity [\%]} = \frac{n_{dead\ target\ cells}}{n_{target\ cells}} \times 100$$

$n$ = number of events

Using GraphPad Prism 5 software (Graph Pad Software, San Diego), the percentage of cytotoxicity was plotted against the corresponding bispecific antibody construct concentrations. Dose response curves were analyzed with the four parametric logistic regression models for evaluation of sigmoid dose response curves with fixed hill slope and EC50 values were calculated.

Example 5.5

Potency of Redirecting Unstimulated Human PBMC Against Human MSLN-Transfected CHO Cells in Absence and Presence of Soluble MSLN The cytotoxic activity of MSLN×CD3 bispecific antibody constructs was analyzed in a FACS-based cytotoxicity assay using CHO cells transfected with human MSLN as target cells, and unstimulated human PBMC as effector cells. The assay was carried out as described in Example 8.4 above.

The results of the FACS-based cytotoxicity assays with unstimulated human PBMC as effector cells and human MSLN-transfected CHO cells as targets are shown in Table 7.

TABLE 6

Cytotoxic Activity of Unstimulated Human PBMC Against Human MSLN-transfected CHO Cells in absence and presence of soluble MSLN

| BiTE × I2C-HALB | w/o sMSLN EC50 [pM] | with 50 ng/ml sMSLN EC50 [pM] | with 400 ng/ml sMSLN EC50 [pM] |
|---|---|---|---|
| MS-1 | 12 | 53 | 215 |
| MS-8 | 3.4 | 8.3 | 39 |
| MS-2 | 2.4 | 2.9 | 6.3 |
| MS-3 | 1.2 | 3.0 | 16 |
| MS-4 | 1.5 | 3.9 | 11 |
| MS-5 | 1.0 | 2.2 | 11 |
| MS-6 | 1.1 | 2.6 | 12 |
| MS-7 | 8.1 | 28 | 166 |

Expectedly, EC50 values were generally higher in cytotoxicity assays with unstimulated PBMC as effector cells compared with cytotoxicity assays using stimulated human CD8+ T cells (see Example 8.2).

Example 5.6

Potency of Redirecting Unstimulated Human PBMC Against the MSLN-Positive Cell Line OVCAR-8 Cells The cytotoxic activity of MSLN×CD3 bispecific antibody constructs was furthermore analyzed in a FACS-based cytotoxicity assay using the MSLN-positive human cell line OVCAR-8 as a source of target cells and unstimulated human PBMC as effector cells. The assay was carried out as described in Example 8.4 above. The results are shown in Table 7.

TABLE 7

EC50 values [pM] of MSLN × CD3 bispecific antibody constructs as measured in a 48-hour FACS-based cytotoxicity assay with unstimulated human PBMC as effector cells and the human cell line OVCAR-8 as source of target cells.

| BiTE × I2C-HALB | EC50 [pM] |
|---|---|
| MS 1 | 5.9 |
| MS 8 | 13 |
| MS 2 | 18 |
| MS 3 | 1.5 |
| MS 4 | 2.0 |
| MS 5 | 1.9 |
| MS 6 | 2.3 |
| MS 7 | 9.7 |

Example 5.7

Potency of Redirecting Macaque T Cells Against Macaque MSLN-Expressing CHO Cells The cytotoxic activity of MSLN×CD3 bispecific antibody constructs was analyzed in a FACS-based cytotoxicity assay using CHO cells transfected with macaque (cyno) MSLN as target cells, and the macaque T cell line 4119LnPx (Knappe et al. Blood 95:3256-61 (2000)) as source of effector cells. Target cell labeling of macaque MSLN-transfected CHO cells and flow cytometry based analysis of cytotoxic activity was performed as described above.

Results are shown in Table 8. Macaque T cells from cell line 4119LnPx were induced to efficiently kill macaque MSLN-transfected CHO cells by MSLN×CD3 bispecific antibody constructs of the invention.

TABLE 8

EC50 values [pM] of MSLN × CD3 bispecific as measured in a 48-hour FACS-based cytotoxicity assay with macaque T cell line 4119LnPx as effector cells and CHO cells transfected with macaque MSLN as target cells.

| BiTE × I2C-HALB | EC50 [pM] |
|---|---|
| MS 1 | 434 |
| MS 8 | 1589 |
| MS 2 | 583 |
| MS 3 | 56 |
| MS 4 | 67 |
| MS 5 | 85 |
| MS 6 | 100 |
| MS 7 | 1791 |

Example 5.8

Potency Gap Between the Monomeric and the Dimeric Isoform of Bispecific Antibody Constructs In order to determine the difference in cytotoxic activity between the monomeric and the dimeric isoform of individual MSLN×CD3 bispecific antibody constructs (referred to as potency gap), an 18 hour 51-chromium release cytotoxicity assay was carried out as described hereinabove (Example 8.1) with purified bispecific antibody construct monomer and dimer. Effector cells were stimulated enriched human CD8+ T cells. Target cells were hu MSLN transfected CHO cells. Effector to target cell (E:T) ratio was 10:1. The potency gap was calculated as ratio between EC50 values.

The results of the assays with stimulated enriched human CD+ T cells as effector cells and human MSLN-transfected CHO cells as targets are shown in Table 9.

TABLE 9

Cytotoxic Activity of Unstimulated Human PBMC Against Human MSLN-transfected CHO Cells using monomeric and dimeric MSLN × CD3 bispecific antibody constructs

| BiTE × I2C-HALB | $EC_{50}$ [pM] | | Monomer to dimer ratio ($EC_{50}$ Monomer/ $EC_{50}$ Dimer) |
|---|---|---|---|
| | Monomer | Dimer | |
| MS 1 | 1.5 | 1.7 | 0.9 |
| MS 8 | 6.5 | 9.5 | 0.7 |
| MS 2 | 2.0 | 2.0 | 1.0 |
| MS 3 | 0.2 | 0.7 | 0.3 |
| MS 4 | 0.1 | 0.9 | 0.1 |
| MS 5 | 0.2 | 1.1 | 0.2 |
| MS 6 | 0.5 | 3.4 | 0.1 |
| MS 7 | 6.0 | 21 | 0.3 |

Example 6

Stability after Incubation for 24 Hours in Human Plasma

Purified bispecific antibody constructs were incubated at a ratio of 1:5 in a human plasma pool at 37° C. for 96 hours at a final concentration of 2-20 µg/ml. After plasma incubation the antibody constructs were compared in a 51-chromium release assay with stimulated enriched human CD8+ T cells and human MSLN-transfected CHO cells at a starting concentration of 0.01-0.1 µg/ml and with an effector to target cell (E:T) ratio of 10:1 (assay as described in Example 8.1). Non-incubated, freshly thawed bispecific antibody constructs were included as controls.

The results are shown in Table 10 below; All tested antibody constructs had a very favourable plasma stability ($EC_{50}$ plasma/$EC_{50}$ control) of ≤4.

TABLE 10

EC50 values of the antibody constructs with and without plasma incubation and calculated plasma/control value

| BiTE × I2C-HALB | $EC_{50}$ [pM] | | Plasma to Control Ratio ($EC_{50}$ Plasma/ $EC_{50}$ Control) |
|---|---|---|---|
| | w/ Plasma | w/o Plasma | |
| MS 1 | 3.0 | 1.5 | 2.0 |
| MS 8 | 4.8 | 6.5 | 0.7 |
| MS 2 | 6.7 | 2.0 | 3.4 |
| MS 3 | 0.3 | 0.2 | 1.5 |
| MS 4 | 0.4 | 0.1 | 4 |
| MS 5 | 0.3 | 0.2 | 1.5 |
| MS 6 | 0.6 | 0.5 | 1.2 |
| MS 7 | 11.4 | 6.0 | 1.9 |

Example 7

Protein Homogeneity by High Resolution Cation Exchange Chromatography

The protein homogeneity the antibody constructs of the invention was analyzed by high resolution cation exchange chromatography CIEX.

50 µg of antibody construct monomer were diluted with 50 ml binding buffer A (20 mM sodium dihydrogen phosphate, 30 mM NaCl, 0.01% sodium octanate, pH 5.5), and 40 ml of this solution were applied to a 1 ml BioPro SP-F column (YMC, Germany) connected to an Äkta Micro FPLC device (GE Healthcare, Germany). After sample binding, a wash step with further binding buffer was carried out. For protein elution, a linear increasing salt gradient using buffer B (20 mM sodium dihydrogen phosphate, 1000 mM NaCl, 0.01% sodium octanate, pH 5.5) up to 50% percent buffer B was applied over 10 column volumes. The whole run was monitored at 280, 254 and 210 nm optical absorbance. Analysis was done by peak integration of the 280 nm signal recorded in the Äkta Unicorn software run evaluation sheet.

The results are shown in Table 11 below. Almost all tested antibody constructs have a very favourable homogeneity of ≥80% (area under the curve (=AUC) of the main peak). The only exception is MS-2×CD3-HALB bispecific construct with merely 67% homogeneity.

TABLE 11

Protein homogeneity of the antibody constructs (% AUC of main peak)

| MSLN HALB BiTE | AUC of Main Peak [%] |
|---|---|
| MS 1 | 100 |
| MS 8 | 93 |
| MS 2 | 67 |
| MS 3 | 87 |
| MS 4 | 80 |
| MS 5 | 89 |
| MS 6 | 81 |
| MS 7 | 100 |

Example 8

Surface Hydrophobicity as Measured by HIC Butyl

The surface hydrophobicity of bispecific antibody constructs of the invention was tested in Hydrophobic Interaction Chromatography HIC in flow-through mode.

50 µg of antibody construct monomer were diluted with generic formulation buffer to a final volume of 500 µl (10 mM citric acid, 75 mM lysine HCl, 4% trehalose, pH 7.0) and applied to a 1 ml Butyl Sepharose FF column (GE Healthcare, Germany) connected to a Äkta Purifier FPLC system (GE Healthcare, Germany). The whole run was monitored at 280, 254 and 210 nm optical absorbance. Analysis was done by peak integration of the 280 nm signal recorded in the Äkta Unicorn software run evaluation sheet. Elution behavior was evaluated by comparing area and velocity of rise and decline of protein signal thereby indicating the strength of interaction of the BiTE albumin fusion with the matrix.

The antibody constructs had a good elution behaviour, which was mostly rapid and complete; see Table 12.

TABLE 12

The surface hydrophobicity of bispecific antibody constructs

| MSLN HALB BiTE | HIC Butyl Elution behavior |
|---|---|
| MS 1 | 1 |
| MS 8 | 1 |

TABLE 12-continued

The surface hydrophobicity of bispecific antibody constructs

| MSLN HALB BiTE | HIC Butyl Elution behavior |
|---|---|
| MS 2 | 1 |
| MS 3 | 1 |
| MS 4 | 1 |
| MS 5 | 1 |
| MS 6 | 1 |
| MS 7 | 1 |

Example 9

Monomer to Dimer Conversion after (i) Three Freeze/Thaw Cycles and (ii) 7 Days of Incubation at 250 µg/ml Bispecific MSLN×CD3 antibody monomeric construct were subjected to different stress conditions followed by high performance SEC to determine the percentage of initially monomeric antibody construct, which had been converted into dimeric antibody construct.

(i) 25 µg of monomeric antibody construct were adjusted to a concentration of 250 µg/ml with generic formulation buffer and then frozen at −80° C. for 30 min followed by thawing for 30 min at room temperature. After three freeze/thaw cycles the dimer content was determined by HP-SEC.

(ii) 25 µg of monomeric antibody construct were adjusted to a concentration of 250 µg/ml with generic formulation buffer followed by incubation at 37° C. for 7 days. The dimer content was determined by HP-SEC.

A high resolution SEC Column TSK Gel G3000 SWXL (Tosoh, Tokyo-Japan) was connected to an Äkta Purifier 10 FPLC (GE Lifesciences) equipped with an A905 Autosampler. Column equilibration and running buffer consisted of 100 mM KH2PO4-200 mM Na2SO4 adjusted to pH 6.6. The antibody solution (25 µg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Äkta Unicorn software run evaluation sheet. Dimer content was calculated by dividing the area of the dimer peak by the total area of monomer plus dimer peak.

The results are shown in Table 13 below. The MSLN× CD3 bispecific antibody constructs of the invention presented with dimer percentages of 0.0% after three freeze/thaw cycles, and with dimer percentages of ≤2.2% after 7 days of incubation at 37° C.

TABLE 13

Percentage of monomeric versus dimeric MSLN × CD3 bispecific antibody constructs as determined by High Performance Size Exclusion Chromatography (HP-SEC).

| MSLN HALB BiTE | BiTE Dimer Conversion [%] |
|---|---|
| MS 1 | 0.2 |
| MS 8 | 1.6 |
| MS 2 | 0.0 |
| MS 3 | 1.7 |

TABLE 13-continued

Percentage of monomeric versus dimeric MSLN ×
CD3 bispecific antibody constructs as determined by
High Performance Size Exclusion Chromatography (HP-SEC).

| MSLN HALB BiTE | BiTE Dimer Conversion [%] |
|---|---|
| MS 4 | 0.3 |
| MS 5 | 1.2 |
| MS 6 | 0.4 |
| MS 7 | 2.2 |

Example 10

Thermostability

Antibody aggregation temperature was determined as follows: 40 µl of antibody construct solution at 250 µg/ml were transferred into a single use cuvette and placed in a Wyatt Dynamic Light Scattering detector device, i.e., Dyna-Pro® NanoStar® (Wyatt), a unique cuvette-based DLS instrument used for the analysis of proteins, promiscuous inhibitors, micelles, quantum dots, liposomes, metallic nanoparticles and more. The sample was heated from 40° C. to 70° C. at a heating rate of 0.5° C./min with constant acquisition of the measured radius. Increase of radius indicating melting of the protein and aggregation was used by the software package delivered with the DLS device to calculate the aggregation temperature of the antibody construct.

All tested MSLN×CD3 bispecific antibody constructs of the invention showed thermal stability with aggregation temperatures 249° C., as shown in Table 14 below. The group of antibody constructs binding to epitope cluster 2+3 even had a thermal stability of 251 and up to more than 56° C.

TABLE 14

Thermostability of the bispecific antibody constructs
as determined by DLS (dynamic light scattering)

| MSLN HALB BiTE | Thermal Stability DLS $T_A$ [° C.] |
|---|---|
| MS 1 | 49.3 |
| MS 8 | 51.0 |
| MS 2 | 53.1 |
| MS 3 | 51.6 |
| MS 4 | 56.5 |
| MS 5 | 54.4 |
| MS 6 | 53.9 |
| MS 7 | 51.4 |

Example 11

Turbidity at 2500 µg/Ml Antibody Concentration 1 ml of purified antibody construct solution of a concentration of 250 µg/ml was concentrated by spin concentration units to 2500 µg/ml. After 16 h storage at 5° C. the turbidity of the antibody solution was determined by OD340 nm optical absorption measurement against the generic formulation buffer.

The results are shown in Table 15 below. All tested antibody constructs have a very favourable turbidity of ≤0.09.

TABLE 15

Turbidity of the antibody constructs after concentration to 2.5 mg/ml over
night

| MSLN HALB BiTE | Turbidity after 16 h @ 2500 µg/ml [OD340] |
|---|---|
| MS 1 | 0.080 |
| MS 8 | 0.079 |
| MS 2 | 0.070 |
| MS 3 | 0.087 |
| MS 4 | 0.076 |
| MS 5 | 0.071 |
| MS 6 | 0.070 |
| MS 7 | 0.066 |

Example 12

BiTE® Induced CD69 Expression on T Cells in Absence of Target Cells

Isolated PBMC from healthy human donors were cultured with increasing CDH19/CD3 or MSLN/CD3 HLE bispecific antibody constructs for 48 h. The expression of the activation marker CD69 on T cells was determined by immunostaining and flow cytometry and antigen specific conjugates mAb.

Target-independent T cell activation in terms of CD69 upregulation was observed for all anti-CDH 19 constructs but was most pronounced for heteroFc and crossbody molecules. Upregulation of CD69 by antiCDH19-scFc occurred at higher concentrations and the amplitude was in part lower compared to the other two Fc-based constructs.

For the anti-MSLN almost no target-independent T cell activation was observed for the scFc-containing molecule, while the heteroFc construct induced a strong upregulation of CD69 on the cell surface T cells in the absence of target cells.

Target-independent T cell activation induced by BiTE® constructs containing a single chain-Fc, or hetero-Fc fusion at the C-terminus was evaluated for the following constructs:

BiTE® constructs (serial dilutions: 0.1 pM-2 µM)
a. MSLN scFc; 1.14 mg/mL;
b. MSLN Hetero Fc; 1.02 mg/

Human PBMC effector cells (3 donors; #065, #823, #836 (scFc) #401, #415, #433 (heteroFc); #590, #595, 598, #605 (X-body)).

48 h incubation time.

Determination of CD69 expression on CD4+ and CD8+ T cells with flow cytometer and antigen-specific conjugates mAb. Results see FIGS. 15A and 15B.

Target-independent T cell activation induced by BiTE® antibody constructs containing a single chain-Fc, hetero-Fc or crossbody fusion at the C-terminus was evaluated for the following constructs:

BiTE® constructs (serial dilutions: 0.1 pM-2 µM)
a. CDH19 scFc; 245.3 µg/mL (
b. CDH-19 Hetero Fc; 1 mg/mL
c. CDH19 Xbody; 6.3 mg/mL Human PBMC effector cells (3 to 4 donors; #386, #392, #401 (scFc) #282, #284, #287 (heteroFc)).

48 h incubation time.

Determination of CD69 expression on CD4+ and CD8+ T cells with flow cytometer and antigen-specific conjugates mAb. Results see FIGS. 16A-16C.

Example 13

Purified Bi-specific T-cell engager (BiTE®, Amgen Research (Munich) GmbH) antibody constructs were coated on a Maxisorb Plate in decreasing concentration (100 nM, 1:4 dilutions). After 3× washing with PBS-T and blocking with PBS/3% (w/v) BSA (60 min, 37° C.), pooled human plasma was incubated for 60 min, 80 rpm at room temperature. After 3× washing a mouse monoclonal antibody specific for human C1q subunit A (CC1q) was added (Thermo MA1-83963, 1:500) for 60 min, 80 rpm, room temperature, after described washing steps a goat anti mouse Fc-POX mAb (1:5,000) was incubated for 60 min, 80 rpm, room temperature. After additional washing, TMB substrate was incubated and stopped after colorimetric reaction by addition of $H_2SO_4$. The absorption was determined at 450 nm.

Figure 17:
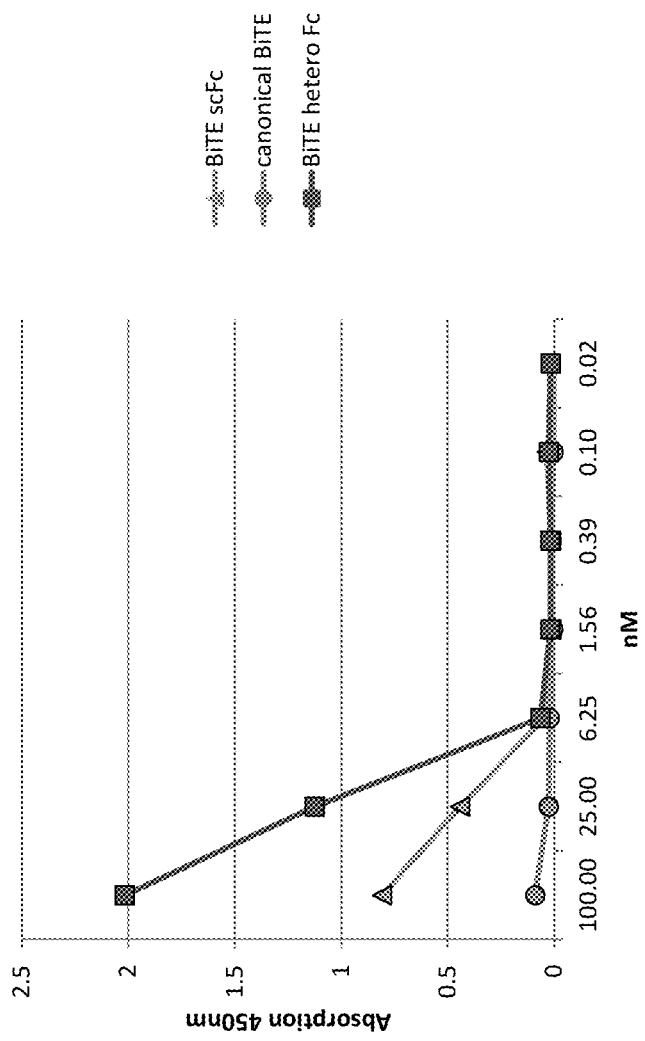

Result: As shown in FIG. 17 at high concentrations, the BiTE® hetero Fc construct (squares) showed higher binding signals for human CC1q compared to a BiTE® single chain Fc construct (triangle). As a negative control a canonical BiTE® (circle) was used, which showed no significant CC1q binding.

Example 14

Pharmacokinetics of BITES Antibody Constructs Fused to Single-Chain Fc-(scFc) and Hetero-Fc (hetFc) Proteins Various target binding BiTE® antibodies were fused to two different half-life extending moieties. The two different HLE-variants per BiTE® antibody, subsequently named as BiTE®-scFc and BiTE®-hetFc, were tested in the cynomolgus monkey in the context of pharmacokinetic (PK) studies. The corresponding nomenclature of these molecules is briefly summarized in Table 16 below.

TABLE 16

Compound nomenclature of nine single dosed BiTE ® HLE antibody constructs

| compound synonym | test compound name |
|---|---|
| Compound 1a | CD33cc-scFc |
| Compound 1b | CD33cc-hetFc |
| Compound 2a | MSLN-scFc |
| Compound 2b | MSLN-hetFc |
| Compound 3a | CDH19-scFc |
| Compound 3b | CH19-hetFc |
| Compound 4 | CD20-scFc |
| Compound 5a | DLL3-scFc |
| Compound 5b | DLL3-hetFc |

The BiTE® HLE antibody construct were administered as intravenous bolus (compounds 1b-5b) and intravenous infusion (compound 1a, 30 min) at 6 µg/kg (compound 2b), 12 µg/kg (compounds 2a and 3a-5b) and 15 µg/kg (compounds 1a and 1b), respectively. For each of the above named compounds a group of at least two to three animals was used. Blood samples were collected and serum was prepared for determination of serum concentrations. Serum BiTE® antibody construct levels were measured using an immunoassay. The assay is performed by capturing the BiTE® via its target moiety, while an antibody directed against the CD3-binding part of the construct was used for detection. The serum concentration-time profiles were used to determine PK parameters. Blood sampling time points are listed in Table 17 below.

TABLE 17

Blood sampling time points during the PK study

| blood sampling time points cmpd. 1a [h] | blood sampling time points cmpd. 1b [h] | blood sampling time points cmpd. 2a-5b [h] |
|---|---|---|
| 0.085 | 0.085 | 0.05 |
| 4.00 | 1 | 0.25 |
| 24.00 | 4 | 0.5 |
| 48.00 | 12 | 1 |
| 72.00 | 24 | 4 |
| 96.00 | 48 | 8 |
| 120.00 | 72 | 24 |
| 144.00 | 96 | 48 |
| 168 | 144 | 72 |
|  | 168 | 168 |
|  |  | 240 |
|  |  | 336 |

Figure 18:
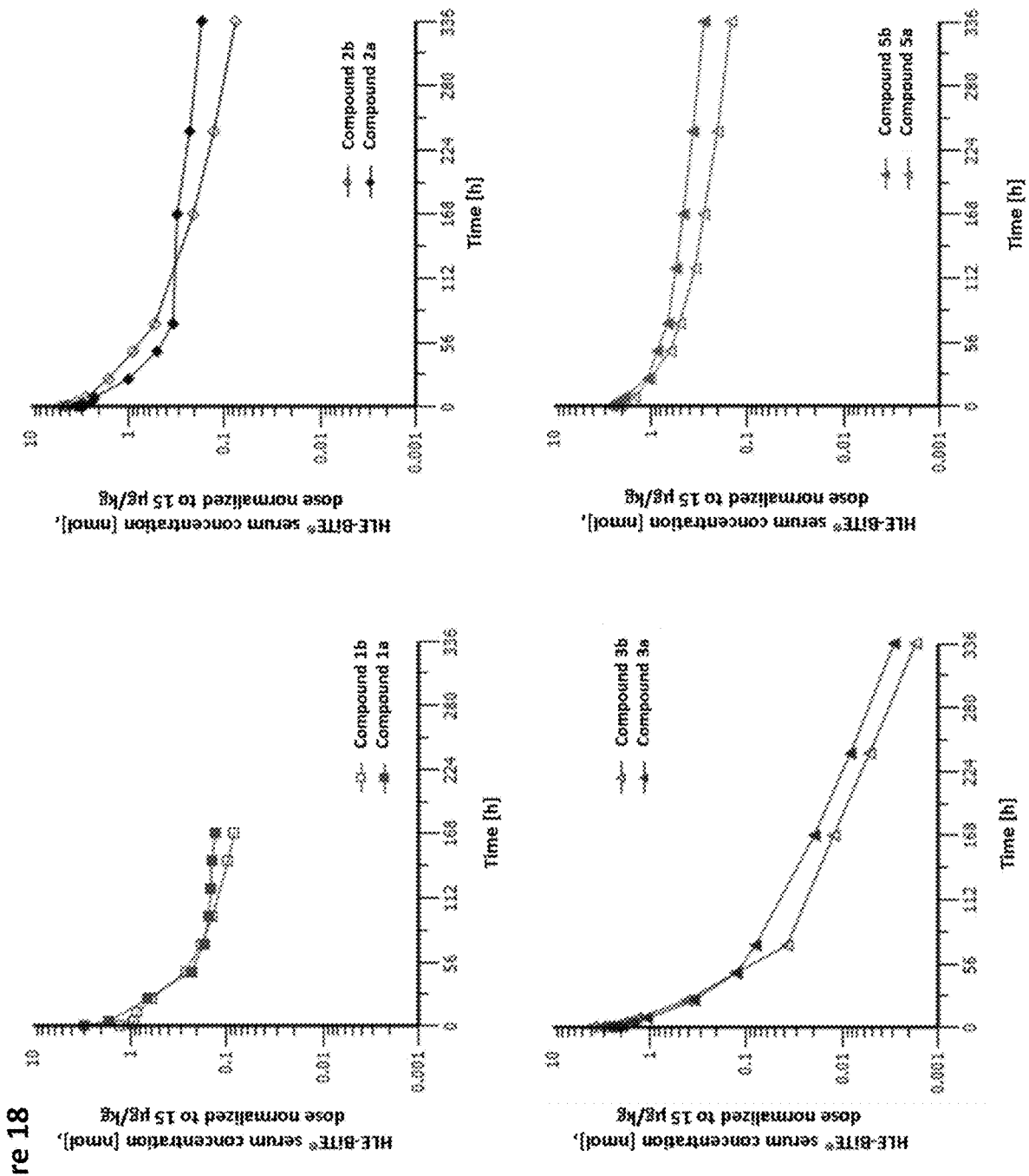
Figure 19:
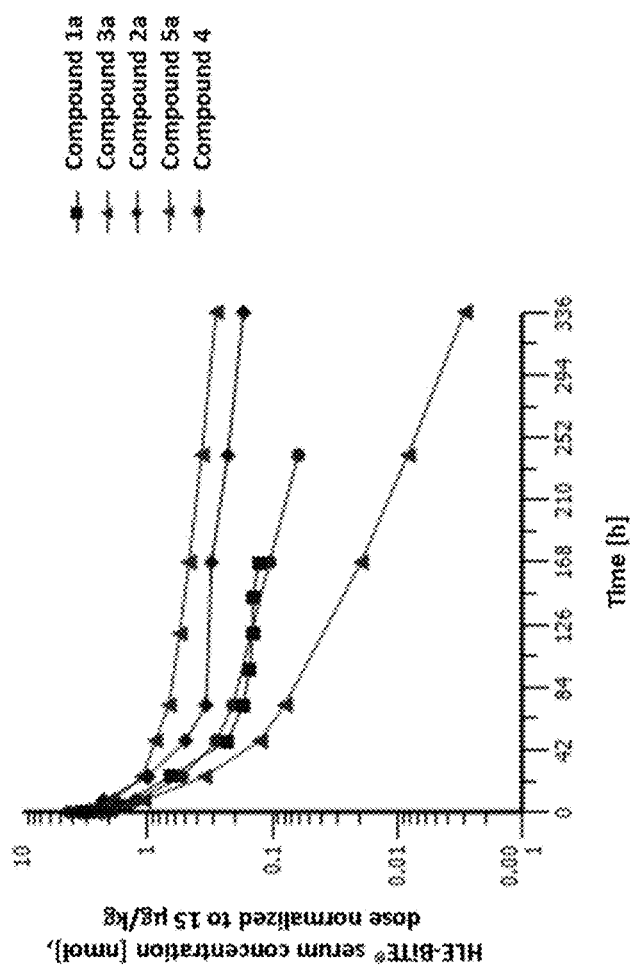

The pharmacokinetics of four BiTE®-HLE antibody construct pairs are shown exemplarily in FIG. 18. Each pair stands for the same BiTE® protein fused to either a scFc- or a hetFc extension. For all proteins serum levels were quantifiable for all time points in all animals after BiTE®-HLE administration. The PK profiles describe a biphasic, exponential decline after each of the single test item administrations.

The pharmacokinetic parameters were determined using standard non-compartmental analysis (NCA) methods. Using non compartmental analysis, the following PK parameters were estimated: AUCinf (Area under the serum concentration-time curve), Vss (volume of distribution at steady state), CL (systemic clearance) and terminal t½ (terminal half-life).

The PK parameter for each tested compound are summarized as mean of n=2 and n=3, respectively in Table 18 below.

TABLE 18

Pharmacokinetic parameter of scFc- and heteroFc-variants from different BiTE ®-target binders in cynomolgus monkeys.

| test item | terminal $t_{1/2}$ [h] | $AUC_{inf}$ [h * ng/mL] | Cl [mL/h/kg] | Vss [mL/kg] |
|---|---|---|---|---|
| Compound 1a | 167 | 6645 | 1.4 | 256 |
| Compound 1b | 95 | 4955 | 2.6 | 261 |
| Compound 2a | 213 | 12072 | 0.73 | 179 |
| Compound 2b | 116 | 6971 | 0.8 | 78 |
| Compound 3a | 61 | 3293 | 3.6 | 129 |
| Compound 3b | 59 | 3633 | 3.3 | 79 |
| Compound 4 | 97 | 6266 | 1.9 | 180 |
| Compound 5a | 234 | 24769 | 0.48 | 144 |
| Compound 5b | 173 | 14639 | 0.82 | 166 |

Overall, the AUCinf for the different BiTE®-HLE pairs of target binders fused to either -scFc and -hetFc moiety, respectively, ranged between 3293 h*ng/mL and 24769 h*ng/mL, depending on the BiTE® target context. All analyzed HLE fusions achieved systemic clearance values of 0.48 to 3.6 mL/h/kg. The corresponding volumes of distribution ranged between 78 and 261 ml/kg.

Example 15

Preformulated drug substances containing purified MSLN-hALB, MSLN-hFc, and MSLN-scFc respectively were buffer exchanged via ultrafiltration/diafiltration using membranes with a molecular weight cut-off (MWCO) of 10 kDa. Final formulation was achieved by adding concentrated stock solutions. Resulting formulations for each construct are listed in Table 19 and comprise K60RTrT composed of 20 mM potassium phosphate, 150 mM L-arginine hydrochloride, 6% (w/V) trehalose dihydrate, 0.01% (w/V) polysorbate 80 at pH 6.0 and G40MSuT composed of 10 mM glutamate, 4% (w/V) mannitol, 2% (w/V) sucrose, 0.01% (w/V) polysorbate 80 at pH 4.0. The target protein concentration was 1.0 mg/mL. Formulated MSLN constructs were filled to 1 mL in type I glass vials which were stoppered with butyl rubber stoppers and crimped with aluminum seals. Filled vials were incubated at –20, 5, 25 and 37° C. One vial of each version was subjected to five freeze and thaw (F/T) cycles. Target freezing temperature was –29° C. Target thawing temperature was 2° C. The ramp rate was approximately 0.3 K/min.

Visual particles were assessed in accordance to the method described by Ph Eur 2.9.20 by trained operators. Visual particle counts per vial are depicted in Table 7. The number of visual (larger than 125 µm) proteinaceous particles was higher for MSLN-hFc if compared to both MSLN-hALB and MSLN-scFc.

TABLE 19

Number of visual proteinaceous particles per vial for stressed and unstressed (T0) samples containing different half-life extended anti-Mesothelin (MSLN) BiTE ® constructs. K60RTrT denotes for a formulation containing 20 mM potassium phosphate, 150 mM L-arginine hydrochloride, 6% (w/V) trehalose dihydrate, 0.01% (w/V) polysorbate 80, pH 6.0. G40MSuT denotes for a formulation containing 10 mM glutamate, 4% (w/V) mannitol, 2% (w/V) sucrose, 0.01% (w/V) polysorbate 80, pH 4.0

| Construct | hALB | hFc | | scFc | |
|---|---|---|---|---|---|
| Formulation | K60RTrT | K60RTrT | G40MSuT | K60RTrT | G40MSuT |
| Number of visible (>125 µm) proteinaceous particles per vial | | | | | |
| T0 | 0 | 0 | 1 | 0 | 0 |
| 5 F./T cycles | 0 | 2 | 2 | 0 | 1 |
| 2 w 5° C. | 0 | 2 | 2 | 0 | 0 |
| 2 w 25° C. | 0 | 2 | 1 | 0 | 0 |
| 2 w 37° C. | 0 | 2 | 2 | 0 | 0 |
| 4 w –20° C. | 0 | 2 | 1 | 0 | 0 |
| 4 w 5° C. | 0 | 1 | 2 | 0 | 0 |
| 4 w 25° C. | 0 | 2 | 2 | 0 | 0 |
| 4 w 37° C. | 0 | 2 | 2 | 0 | 0 |

The samples described above were also analyzed by size exclusion ultra-high performance chromatography (SE-UPLC) in order to quantify the percentaged content of high molecular weight species (HMWS). SE-UPLC was performed on an AcquityH-Class UPLC system (Waters) using an Acquity UPLC BEH200 SEC 150 mm column (Waters). Column temperature was set to 25° C. Separation of size variants was achieved by applying an isocratic method with a flow rate of 0.4 mL/min. The mobile phase was composed of 100 mM sodium phosphate, 250 mM NaCl at pH 6.8. The run time totals 6.0 minutes. Samples were held at 8° C. within the autosampler until analysis. A total amount of 3 µg protein was injected. In order to avoid carry over an intermediate injection with 40% acetonitrile was performed after each sample. Detection was based on fluorescence emission (excitation at 280 nm, emission at 325 nm). Peak integration was performed using Empower® software. Relative area under the curve of HMWS was reported (Table 20).

Fc based constructs exhibited lower HMWS contents in the formulation variant G40MSuT than in K60RTrT independent on the stress condition. It became evident that MSLN-scFc contained less HMWS than MSLN-hFc in both G40MSuT as well as K60RTrT preparations. MSLN-scFc in its preferred formulation (G40MSuT) was less prone to HMWS formation than MSLN-hALB formulated in K60RTrT. In previous experiments this buffer showed improved stabilizing potential for hALB based constructs if compared to formulations with more acidic pH values.

TABLE 20

Overview on HMWS contents in stressed and unstressed (T0) MSLN-hALB, -hFc, and -scFc preparations determined via SE-UPLC

| Construct | hALB | hFc | | scFc | |
|---|---|---|---|---|---|
| Formulation | K60RTrT | K60RTrT | G40MSuT | K60RTrT | G40MSuT |
| | | % HMWS | | | |
| T0 | 1.8 | 6.7 | 3.3 | 2.5 | 1.3 |
| 5 F./T cycles | 2.0 | 7.2 | 4.1 | 3.0 | 1.5 |
| 2 w 5° C. | n.t. | n.t. | n.t. | 2.9 | 1.1 |
| 2 w 25° C. | n.t. | 6.6 | 2.7 | 2.4 | 0.5 |
| 2 w 37° C. | 2.6 | 6.3 | 2.1 | 2.7 | 0.3 |
| 4 w –20° C. | 5.9 | 8.7 | 1.6 | 6.6 | 0.3 |
| 4 w 5° C. | 2.0 | 8.2 | 2.8 | 3.6 | 0.6 |
| 4 w 25° C. | 2.2 | 6.8 | 2.6 | 2.7 | 0.4 |
| 4 w 37° C. | 3.5 | 7.6 | 1.9 | 4.3 | 0.3 | n.t. = not tested

The abundance of chemical modifications upon heat stress (incubation at 37° C.) was monitored by peptide mapping. Protein samples were enzymatically digested and the resulting peptides were separated using reversed phase chromatography. The column eluate was directly injected into the ion source of a mass spectrometer for identification and quantitation of the peptides.

In order to achieve maximum coverage, two separate enzyme digests were performed: once with trypsin and once with chymotrypsin. In each case, the proteins were denatured with guanidinum chloride and then reduced with dithiothreitol (DTT). After incubation in DTT, free cysteine residues were alkylated by the addition of iodoacetic acid. Samples were then buffer exchanged into 50 mM Tris pH 7.8 for digestion. Trypsin and chymotrypsin were added to separate reaction tubes at a ratio of 1:10 (sample:enzyme) each. Samples were digested for 30 min at 37° C. and the reaction was quenched by adding trifluoroacetic acid.

A load of 5 µg of each digest was separately injected onto a Zorbax SB-C18 (Agilent #859700-902) reversed phase column equilibrated in 0.1% (VN) formic acid (FA). A 156 minutes gradient of up to 90% acetonitrile containing 0.1% FA was used to elute the peptides directly into the electrospray ion source of a Q-Exactive Plus mass spectrometer (Thermo Scientific). Data was collected in data dependent mode using a top 12 method in which a full scan (resolution 70 000; scan range 200-2000 m/z) was followed by high energy collision dissociation (HCD) of the 12 most abundant ions (resolution 17 500).

Peptides were identified based on accurate mass and tandem mass spectrum using in-house software. Identifications were manually verified. Relative quantities of modified and unmodified peptides were calculated based on ion abundance using Pinpoint software (Thermo Scientific).

Percentages of chemical modifications of the complement determining regions (CDRs) and of the half-life extending portion (either hALB or Fc) detected in MSLN-hALB, -hFc, and -scFc preparations are given by Table 21. When comparing similar formulation conditions, it became obvious that overall, chemical modifications were least abundant in scFc constructs.

TABLE 21

Overview on chemical modifications in stressed and unstressed (T0) MSLN-hALB, -hFc, and -scFc preparations determined via peptide mapping

| Construct | hALB | hFc | | scFc | |
|---|---|---|---|---|---|
| Formulation | K60RTrT | K60RTrT | G40MSuT | K60RTrT | G40MSuT |
| % N101 deamidation (CDR) | | | | | |
| T0 | 0.1 | 0.2 | 0.2 | 0.2 | 0.2 |
| 2 w 37° C. | 0.7 | 0.8 | 3.0 | 0.7 | 3.2 |
| 4 w 37° C. | 1.3 | n.t. | 8.5 | n.t. | 6.4 |
| % N162 deamidation (CDR) | | | | | |
| T0 | 3.0 | 1.7 | 1.9 | 2.3 | 2.5 |
| 2 w 37° C. | 15.9 | 11.6 | 2.7 | 15.0 | 3.3 |
| 4 w 37° C. | 26.8 | n.t. | 3.7 | n.t. | 4.1 |
| % M279 oxidation (CDR) | | | | | |
| T0 | 0.6 | 1.4 | 1.6 | 0.6 | 1.0 |
| 2 w 37° C. | 1.2 | 0.8 | 0.8 | 0.6 | 1.0 |
| 4 w 37° C. | 0.9 | n.t. | 0.8 | n.t. | 0.6 |
| % N348 deamidation (CDR) | | | | | |
| T0 | 0.5 | 3.2 | 3.3 | 0.5 | 0.9 |
| 2 w 37° C. | 20.5 | 21.6 | 1.9 | 9.4 | 1.3 |
| 4 w 37° C. | 22.8 | n.t. | 2.0 | n.t. | 2.9 |
| % N351 deamidation (CDR) | | | | | |
| T0 | 0.2 | 2.9 | 2.6 | 0.5 | 1.0 |
| 2 w 37° C. | 6.6 | 12.7 | 0.9 | 3.8 | 0.4 |
| 4 w 37° C. | 8.7 | n.t. | 0.8 | n.t. | 0.8 |
| % M530 oxidation (Fc) | | | | | |
| T0 | n.a. | 3.9 | 4.1 | 2.6 | 3.2 |
| 2 w 37° C. | n.a. | 9.0 | 3.1 | 4.0 | 4.3 |
| 4 w 37° C. | n.a. | n.t. | 3.4 | n.t. | 3.5 |
| % N603 deamidation (Fc) | | | | | |
| T0 | n.a. | 1.3 | 1.9 | 1.3 | 1.4 |
| 2 w 37° C. | n.a. | 7.9 | 4.6 | 7.0 | 5.6 |
| 4 w 37° C. | n.a. | n.t. | 6.9 | n.t. | 8.1 |
| % M706 oxidation (Fc) | | | | | |
| T0 | n.a. | 3.2 | 3.6 | 1.5 | 2.1 |
| 2 w 37° C. | n.a. | 6.0 | 2.8 | 2.1 | 2.5 |
| 4 w 37° C. | n.a. | n.t. | 2.6 | n.t. | 2.0 |
| % M587 oxidation (hALB) | | | | | |
| T0 | 1.0 | n.a. | n.a. | n.a. | n.a. |
| 2 w 37° C. | 2.2 | n.a. | n.a. | n.a. | n.a. |
| 4 w 37° C. | 2.3 | n.a. | n.a. | n.a. | n.a. |
| % M623 oxidation (hALB) | | | | | |
| T0 | 1.9 | n.a. | n.a. | n.a. | n.a. |
| 2 w 37° C. | 2.4 | n.a. | n.a. | n.a. | n.a. |
| 4 w 37° C. | 3.0 | n.a. | n.a. | n.a. | n.a. |
| % M798 oxidation (hALB) | | | | | |
| T0 | 1.4 | n.a. | n.a. | n.a. | n.a. |
| 2 w 37° C. | 3.3 | n.a. | n.a. | n.a. | n.a. |
| 4 w 37° C. | 3.5 | n.a. | n.a. | n.a. | n.a. |
| % M829 oxidation (hALB) | | | | | |
| T0 | 8.9 | n.a. | n.a. | n.a. | n.a. |
| 2 w 37° C. | 42.9 | n.a. | n.a. | n.a. | n.a. |
| 4 w 37° C. | 44.1 | n.a. | n.a. | n.a. | n.a. | n.a. = not applicable;
n.t. = not tested

Example 16

MSLN-hALB, -hFc, -scFc formulated as described under Example 15 were subjected to a pH jump experiment. The concentration of the starting materials was 1.0 mg/mL. A volume of 0.38 mL of each starting material was filled in a glass vial. After preconditioning at 37° C. the solutions were spiked with 20 fold phosphate buffered saline (PBS) which was composed of 0.090 M potassium phosphate, 0.480 M sodium phosphate (both dibasic), 0.052 M potassium chloride and 2.76 M NaCl. The spiked samples were incubated at 37° C. for two weeks. After incubation they were analyzed by SE-UPLC using the method described under Example 15 and the percentaged content of HMWS was reported (Table 22). When comparing all constructs formulated in K60RTrT the HMWS content increased in the following order: hALB<scFc<hFc. MSLN-scFc also showed a lower HMWS content than MSLN-hFc when formulated in G40MSuT.

TABLE 22

Overview on HMWS contents in stressed (pH jump + 2 w 37° C.) MSLN-hALB, -hFc, and -scFc preparations determined via SE-UPLC

| Construct | hALB | hFc | | scFc | |
|---|---|---|---|---|---|
| Formulation | K60RTrT | K60RTrT | G40MSuT | K60RTrT | G40MSuT |
| % HMWS | | | | | |
| 2 w 37° C. | 1.5 | 8.3 | 7.1 | 5.4 | 5.1 |

Example 17

MSLN-hALB, -hFc, and -scFc formulated as described under Example 15 were subjected to agitation stress. The concentration of the starting materials was 1.0 mg/mL. A volume of 0.5 mL of each solution was filtered through an appropriate 0.22 μm filter and filled into 3 cc glass vials. The vials were placed in a plastic box ensuring that the vials were not displaced within the box during agitation. The box was placed onto an orbital shaker. The samples were agitated at 500 rpm for 65 hours. Visual particles were assessed in accordance to the method described by Ph Eur 2.9.20. The method was conducted by trained operators. Visual particle counts per vial are depicted in Table 23. Visible proteinaceous particles were only observed in MSLN-hFc preparations.

TABLE 23

Number of visual proteinaceous particles per vial in agitated samples

| Construct | hALB | hFc | | scFc | |
|---|---|---|---|---|---|
| Formulation | K60RTrT | K60RTrT | G40MSuT | K60RTrT | G40MSuT |
| Number of visible (>125 μm) proteinaceous particles per vial | | | | | |
| 65 h, 500 rpm | 0 | 1 | 1 | 0 | 0 |

Above samples were also analyzed by size exclusion ultra-high performance chromatography (SE-UPLC) in order to quantify the percentaged content of high molecular weight species (HMWS). The same method as described in Example 15 was applied. The HMWS contents of agitated samples are outlined by Table 24. The formation of HMWS was most pronounced in MSLN-hFc when comparing K60RTrT preparations. For Fc based constructs the HMWS contents could be reduced by lowering the formulation pH (G40MSuT). But again HMWS were more abundant in MSLN-hFc than in MLSN-scFc.

TABLE 24

Overview on HMWS contents in stressed (pH jump + 2 w 37° C.) MSLN-hALB, -hFc, and -scFc preparations determined via SE-UPLC

| Construct | hALB | hFc | | scFc | |
|---|---|---|---|---|---|
| Formulation | K60RTrT | K60RTrT | G40MSuT | K60RTrT | G40MSuT |
| | | | % HMWS | | |
| 65 h, 500 rpm | 1.8 | 5.8 | 2.4 | 1.8 | 0.3 |

Example 17

MSLN-hALB, -hFc, and -scFc formulated as described under Example 15 were exposed to visible and UVA light (photo stress). Protein concentration totaled 1 mg/mL in all preparations. Protein solutions were filtered through a filter with 0.22 μm pore size and filled to 0.5 mL in type I glass vials. MSLN-hALB and -scFc were subjected to two different tests including 0.2 MLux visible light/25 W*h/m² UVA light and 1.2 MLux visible light/173 W*h/m² respectively. MSLN-hFc was subjected to two different tests including 0.2 MLux visible light without UVA light and 1.2 MLux visible light/30 W*h/m² UVA light respectively. Chamber temperatures were adjusted to 25° C. After light exposure samples were analyzed by visible inspection (Table 25), SE-UPLC (Table 26) and peptide map (Table 27). Aforementioned methods were performed according to the procedures described under Example 15. Although MSLN-hALB, and -scFc were exposed to higher doses of UVA light, no visible proteinaceous particles was observed whereas MSLN-hFc samples exhibited one visible proteinaceous particle per vial for both tests irrespective of the formulation.

TABLE 25

Overview on the number of visible proteinaceous particles per vial in MSLN-hALB, -hFc, and -scFc preparations determined after light exposure

| Construct | hALB | hFc | | scFc | |
|---|---|---|---|---|---|
| Formulation | K60RTrT | K60RTrT | G40MSuT | K60RTrT | G40MSuT |
| | Number of visible (>125 μm) proteinaceous particles per vial | | | | |
| T0 | 0 | 0 | 1 | 0 | 0 |
| Test 1 | 0[1] | 1[2] | 1[2] | 0[1] | 0[1] |
| Test 2 | 0[3] | 1[4] | 1[4] | 0[3] | 0[3] |

[1] 0.2 MLux vsible light/25 W * h/m² UVA light,
[2] 0.2 MLux visible light without UVA light,
[3] 1.2 MLux visible light/173 W * h/m²,
[4] 1.2 MLux visible light/30 W * h/m²

HMWS increased in the following order MSLN-hALB<-scFc<-hFc when the protein was formulated in K60RTrT. HMWS could be reduced for Fc based constructs when formulated in G40MSuT. However HMWS were again less pronounced for MSLN-scFc. MSLN-hFc revealed to be especially sensitive towards UVA light exposure.

TABLE 26

Overview on HMWS contents in MSLN-hALB, -hFc, and -scFc preparations determined after light exposure via SE-UPLC

| Construct | hALB | hFc | | scFc | |
|---|---|---|---|---|---|
| Formulation | K60RTrT | K60RTrT | G40MSuT | K60RTrT | G40MSuT |
| | | | % HMWS | | |
| T0 | 1.8 | 6.7 | 3.3 | 2.5 | 1.3 |
| Test 1 | 1.8[1] | 6.3[2] | 2.5[2] | 2.1[1] | 0.4[1] |
| Test 2 | 2.0[3] | 11.0[4] | 2.1[4] | 2.4[3] | 0.3[3] |

[1] 0.2 MLux vsible light/25 W * h/m² UVA light,
[2] 0.2 MLux visible light without UVA light,
[3] 1.2 MLux visible light/173 W * h/m²,
[4] 1.2 MLux visible light/30 W * h/m²

Percentages of chemical modifications of the complement determining regions (CDRs) and of the half-life extending portion (either hALB or Fc) detected in MSLN-hALB, -hFc, and -scFc preparations are given by Table 27. When comparing similar formulation conditions, it became obvious that overall, chemical modifications were least abundant in scFc constructs.

TABLE 27

Overview on chemical modifications in MSLN-hALB, -hFc, and -scFc preparations determined after light exposure via peptide mapping

| Construct | hALB | hFc | | scFc | |
|---|---|---|---|---|---|
| Formulation | K60RTrT | K60RTrT | G40MSuT | K60RTrT | G40MSuT |
| | % N101 deamidation (CDR) | | | | |
| T0 | 0.1 | 0.2 | 0.2 | 0.2 | 0.2 |
| Test 1 | 0.2[1] | n.t. | 0.3[2] | n.t. | 0.5[1] |
| Test 2 | 0.2[3] | n.t. | 0.6[4] | n.t. | 0.7[3] |
| | % N162 deamidation (CDR) | | | | |
| T0 | 3.0 | 1.7 | 1.9 | 2.3 | 2.5 |
| Test 1 | 3.0[1] | n.t. | 2.1[2] | n.t. | 2.7[1] |
| Test 2 | 3.6[3] | n.t. | 3.1[4] | n.t. | 2.8[3] |
| | % M279 oxidation (CDR) | | | | |
| T0 | 0.6 | 1.4 | 1.6 | 0.6 | 1.0 |
| Test 1 | 0.8[1] | n.t. | 2.6[2] | n.t. | 0.6[1] |
| Test 2 | 1.0[3] | n.t. | 6.3[4] | n.t. | 0.7[3] |
| | % N348 deamidation (CDR) | | | | |
| T0 | 0.5 | 3.2 | 3.3 | 0.5 | 0.9 |
| Test 1 | 0.4[1] | n.t. | 2.7[2] | n.t. | 0.2[1] |
| Test 2 | 0.9[3] | n.t. | 3.9[4] | n.t. | 0.2[3] |
| | % N351 deamidation (CDR) | | | | |
| T0 | 0.2 | 2.9 | 2.6 | 0.5 | 1.0 |
| Test 1 | 0.4[1] | n.t. | 2.0[2] | n.t. | 0.3[1] |
| Test 2 | 0.5[3] | n.t. | 2.6[4] | n.t. | 0.3[3] |
| | % M530 oxidation (Fc) | | | | |
| T0 | n.a. | 3.9 | 4.1 | 2.6 | 3.2 |
| Test 1 | n.a. | n.t. | 7.6[2] | n.t. | 3.1[1] |
| Test 2 | n.a. | n.t. | 21.8[4] | n.t. | 4.1[3] |
| | % M706 oxidation (Fc) | | | | |
| T0 | n.a. | 3.2 | 3.6 | 1.5 | 2.1 |
| Test 1 | n.a. | n.t. | 6.5[2] | n.t. | 1.8[1] |
| Test 2 | n.a. | n.t. | 17.8[4] | n.t. | 2.7[3] |
| | % M587 oxidation (hALB) | | | | |
| T0 | 1.0 | n.a. | n.a. | n.a. | n.a. |
| Test 1 | 1.5 | n.a. | n.a. | n.a. | n.a. |
| Test 2 | 2.4 | n.a. | n.a. | n.a. | n.a. |

TABLE 27-continued

Overview on chemical modifications in MSLN-hALB, -hFc, and -scFc preparations determined after light exposure via peptide mapping

| Construct | hALB | hFc | | scFc | |
|---|---|---|---|---|---|
| Formulation | K60RTrT | K60RTrT | G40MSuT | K60RTrT | G40MSuT |
| % M623 oxidation (hALB) | | | | | |
| T0 | 1.9 | n.a. | n.a. | n.a. | n.a. |
| Test 1 | 4.0 | n.a. | n.a. | n.a. | n.a. |
| Test 2 | 4.1 | n.a. | n.a. | n.a. | n.a. |
| % M798 oxidation (hALB) | | | | | |
| T0 | 1.4 | n.a. | n.a. | n.a. | n.a. |
| Test 1 | 2.1 | n.a. | n.a. | n.a. | n.a. |
| Test 2 | 3.1 | n.a. | n.a. | n.a. | n.a. |
| % M829 oxidation (hALB) | | | | | |
| T0 | 8.9 | n.a. | n.a. | n.a. | n.a. |
| Test 1 | 31.0 | n.a. | n.a. | n.a. | n.a. |
| Test 2 | 25.2 | n.a. | n.a. | n.a. | n.a. | n.a. = not applicable;
n.t. = not tested

Example 18

MSLN-hALB was formulated in K60RTrT and MSLN-scFc was formulated in G40MSuT according to the procedure described in Example 15. Protein concentrations totaled 0.05 mg/mL. Glass (borosilicate, type I, 13 mm 3 cc vial from West, Art. No. 68000375) and polypropylene test containers (2 mL with O-ring, e.g. from Sarstedt, Art No. 72.694.005) are filled with 500 µL of the test solution. The test solution was left for five minutes in the first test container. Then a 150 µL aliquot was sampled for analysis. The remaining test solution (350 µL) was transferred sequentially from one test container to the next (five containers in total). In each vial, the solution was left for five minutes before the next transfer. The same pipette tip was used for each transfer step. The same test was performed using 30 mL polycarbonate bottles (Nalgene, PCS-000295 with closure, PP/20-415/ZTPE). For this container type the first container was filled with 5 mL. After a 150 µL aliquot was sampled, the residual volume was transferred from one test container to the next (according to the procedure described above). Samples pulled from container #1 and #5 were analyzed by SE-UPLC (method as described under Example 15). In addition protein detection was carried out with a PDA detector (280 nm) in order to determine protein concentrations. Percentaged protein recovery from each test container is given by Table 28. It was shown that protein recovery was more pronounced for MSLN-scFc than for MSLN-hALB irrespective of the container type.

TABLE 28

Protein recovery from different container types for MSLN-hALB, and -scFc determined by SE-UPLC

| Construct | hALB | scFc |
|---|---|---|
| Formulation | K60RTrT | G40MSuT |
| % Protein recovery (from nominal) | | |
| Type I glass | 80.0 | 92.0 |
| Polypropylene | 87.0 | 97.3 |
| Polycarbonate | 87.0 | 96.0 |

Example 19

MSLN-hALB was formulated in K60RTrT and MSLN-scFc was formulated in K60RTrT and G40MSuT according to the procedure described in Example 15. The protein concentration totaled 1.0 mg/mL. 1950 µL of each test solution was spiked with 50 µL of a 1000 ppm silicon standard solution (Specpure from AlfaAesar, Art. No. 38717) resulting in a 25 ppm spike. An unspiked test solution served as control sample. The spiked test solution as well as the control sample were filled into 3 cc type I glass vials and were incubated at 37° C. for 24 hours. All samples were analyzed by SE-UPLC according to the method described in Example 15 in order to quantify the amount of HMWS (Table 29). When formulated in K60RTrT, MSLN-hALB and -scFc showed similar increases in HMWS upon silicon spiking. For the scFc construct it could be shown that this increase could be reduced by lowering the formulation pH to 4.0. According to preliminary experiments, this approach was not feasible for MLSN-hALB since it revealed to undergo fragmentation at formulation pH values of 5.0 and below.

TABLE 29

Overview on HMWS contents in MSLN-hALB, and -scFc preparations determined via SE-UPLC after spiking with 25 ppm silicon

| Construct | hALB | scFc | |
|---|---|---|---|
| Formulation | K60RTrT | K60RTrT | G40MSuT |
| Δ % HMWS (compared to unspiked control) | | | |
| 25 ppm spike | 1.0 | 1.0 | 0.2 |

TABLE 30

Seqence Listing

| SEQ ID NO: | Description | Source | Sequence |
|---|---|---|---|
| 1. | Peptide linker | artificial | GGGG |
| 2. | Peptide linker | artificial | GGGGS |
| 3. | Peptide linker | artificial | GGGGQ |
| 4. | Peptide linker | artificial | PGGGGS |

TABLE 30-continued

Seqence Listing

| SEQ ID NO: | Description | Source | Sequence |
|---|---|---|---|
| 5. | Peptide linker | artificial | PGGDGS |
| 6. | Peptide linker | artificial | SGGGGS |
| 7. | Peptide linker | artificial | GGGGSGGGS |
| 8. | Peptide linker | artificial | GGGGSGGGGS |
| 9. | Peptide linker | artificial | GGGGSGGGGSGGGGS |
| 10. | Hexa-histidine | artificial | HHHHHH |
| 11. | CDR-L1 of F6A | artificial | GSSTGAVTSGYYPN |
| 12. | CDR-L2 of F6A | artificial | GTKFLAP |
| 13. | CDR-L3 of F6A | artificial | ALWYSNRWV |
| 14. | CDR-H1 of F6A | artificial | IYAMN |
| 15. | CDR-H2 of F6A | artificial | RIRSKYNNYATYYADSVKS |
| 16. | CDR-H3 of F6A | artificial | HGNFGNSYVSFFAY |
| 17. | VH of F6A | artificial | EVQLVESGGGLVQPGGSLKLSCAASGFTFNIYAMNWVRQAPGKGLEWVARIRSKYNNYATYYADSVKSRFTISRDDSKN TAYLQMNNLKTEDTAVYYCVRHGNFGNSYVSFFAYWGQGTLVTVSS |
| 18. | VL of F6A | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |
| 19. | VH-VL of F6A | artificial | EVQLVESGGGLVQPGGSLKLSCAASGFTFNIYAMNWVRQAPGKGLEWVARIRSKYNNYATYYADSVKSRFTISRDDSKN TAYLQMNNLKTEDTAVYYCVRHGNFGNSYVSFFAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 20. | CDR-L1 of H2C | artificial | GSSTGAVTSGYYPN |
| 21. | CDR-L2 of H2C | artificial | GTKFLAP |
| 22. | CDR-L3 of H2C | artificial | ALWYSNRWV |
| 23. | CDR-H1 of H2C | artificial | KYAMN |
| 24. | CDR-H2 of H2C | artificial | RIRSKYNNYATYYADSVKD |
| 25. | CDR-H3 of H2C | artificial | HGNFGNSYISYWAY |
| 26. | VH of H2C | artificial | EVQLVESGGGLVQPGGSLKLSCAASGFTFNKYAMNWVRQAPGKGLEWVARIRSKYNNYATYYADSVKDRFTISRDDSKN TAYLQMNNLKTEDTAVYYCVRHGNFGNSYISYWAYWGQGTLVTVSS |
| 27. | VL of H2C | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |

TABLE 30-continued

Sequence Listing

| SEQ ID NO: | Description | Source | Sequence |
|---|---|---|---|
| 28. | VH-VL of H2C | artificial | EVQLVESGGGLVQPGGSLKLSCAASGFTFNKYAMNWVRQAPGKGLEWVARIRSKYNNYATYYADSVKDRFTISRDDSKN TAYLQMNNLKTEDTAVYYCVRHGNFGNSYISYWAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 29. | CDR-L1 of H1E | artificial | GSSTGAVTSGYYPN |
| 30. | CDR-L2 of H1E | artificial | GTKFLAP |
| 31. | CDR-L3 of H1E | artificial | ALWYSNRWV |
| 32. | CDR-H1 of H1E | artificial | SYAMN |
| 33. | CDR-H2 of H1E | artificial | RIRSKYNNYATYYADSVKG |
| 34. | CDR-H3 of H1E | artificial | HGNFGNSYLSFWAY |
| 35. | VH of H1E | artificial | EVQLVESGGGLEQPGGSLKLSCAASGFTFNSYAMNWVRQAPGKGLEWVARIRSKYNNYATYYADSVKGRFTISRDDSKN TAYLQMNNLKTEDTAVYYCVRHGNFGNSYLSFWAYWGQGTLVTVSS |
| 36. | VL of H1E | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |
| 37. | VH-VL of H1E | artificial | EVQLVESGGGLEQPGGSLKLSCAASGFTFNSYAMNWVRQAPGKGLEWVARIRSKYNNYATYYADSVKGRFTISRDDSKN TAYLQMNNLKTEDTAVYYCVRHGNFGNSYLSFWAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 38. | CDR-L1 of G4H | artificial | GSSTGAVTSGYYPN |
| 39. | CDR-L2 of G4H | artificial | GTKFLAP |
| 40. | CDR-L3 of G4H | artificial | ALWYSNRWV |
| 41. | CDR-H1 of G4H | artificial | RYAMN |
| 42. | CDR-H2 of G4H | artificial | RIRSKYNNYATYYADSVKG |
| 43. | CDR-H3 of G4H | artificial | HGNFGNSYLSYFAY |
| 44. | VH of G4H | artificial | EVQLVESGGGLVQPGGSLKLSCAASGFTFNRYAMNWVRQAPGKGLEWVARIRSKYNNYATYYADSVKGRFTISRDDSKN TAYLQMNNLKTEDTAVYYCVRHGNFGNSYLSYFAYWGQGTLVTVSS |
| 45. | VL of G4H | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |
| 46. | VH-VL of G4H | artificial | EVQLVESGGGLVQPGGSLKLSCAASGFTFNRYAMNWVRQAPGKGLEWVARIRSKYNNYATYYADSVKGRFTISRDDSKN TAYLQMNNLKTEDTAVYYCVRHGNFGNSYLSYFAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 47. | CDR-L1 of A2J | artificial | RSSTGAVTSGYYPN |
| 48. | CDR-L2 of A2J | artificial | ATDMRPS |
| 49. | CDR-L3 of A2J | artificial | ALWYSNRWV |
| 50. | CDR-H1 of A2J | artificial | VYAMN |

TABLE 30-continued

Sequence Listing

| SEQ ID NO: | Description | Source | Sequence |
|---|---|---|---|
| 51. | CDR-H2 of A2J | artificial | RIRSKYNNYATYYADSVKK |
| 52. | CDR-H3 of A2J | artificial | HGNFGNSYLSWWAY |
| 53. | VH of A2J | artificial | EVQLVESGGGLVQPGGSLKLSCAASGFTFNVYAMNWVRQAPGKGLEWVARIRSKYNNYATYYADSVKKRFTISRDDSKN TAYLQMNNLKTEDTAVYYCVRHGNFGNSYLSWWAYWGQGTLVTVSS |
| 54. | VL of A2J | artificial | QTVVTQEPSLTVSPGGTVTLTCRSSTGAVTSGYYPNWVQQKPGQAPRGLIGATDMRPSGTPARFSGSLLGGKAALTLSG VQPEDEAEYYCALWYSNRWVFGGGTKLTVL |
| 55. | VH-VL of A2J | artificial | EVQLVESGGGLVQPGGSLKLSCAASGFTFNVYAMNWVRQAPGKGLEWVARIRSKYNNYATYYADSVKKRFTISRDDSKN TAYLQMNNLKTEDTAVYYCVRHGNFGNSYLSWWAYWGQGTLVTVSSGGGGSGGGGSGGGGSQTVVTQEPSLTVSPGGTV TLTCRSSTGAVTSGYYPNWVQQKPGQAPRGLIGATDMRPSGTPARFSGSLLGGKAALTLSGVQPEDEAEYYCALWYSNR WVFGGGTKLTVL |
| 56. | CDR-L1 of E1L | artificial | GSSTGAVTSGYYPN |
| 57. | CDR-L2 of E1L | artificial | GTKFLAP |
| 58. | CDR-L3 of E1L | artificial | ALWYSNRWV |
| 59. | CDR-H1 of E1L | artificial | KYAMN |
| 60. | CDR-H2 of E1L | artificial | RIRSKYNNYATYYADSVKS |
| 61. | CDR-H3 of E1L | artificial | HGNFGNSYTSYYAY |
| 62. | VH of E1L | artificial | EVQLVESGGGLVQPGGSLKLSCAASGFTFNKYAMNWVRQAPGKGLEWVARIRSKYNNYATYYADSVKSRFTISRDDSKN TAYLQMNNLKTEDTAVYYCVRHGNFGNSYTSYYAYWGQGTLVTVSS |
| 63. | VL of E1L | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |
| 64. | VH-VL of E1L | artificial | EVQLVESGGGLVQPGGSLKLSCAASGFTFNKYAMNWVRQAPGKGLEWVARIRSKYNNYATYYADSVKSRFTISRDDSKN TAYLQMNNLKTEDTAVYYCVRHGNFGNSYTSYYAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 65. | CDR-L1 of E2M | artificial | RSSTGAVTSGYYPN |
| 66. | CDR-L2 of E2M | artificial | ATDMRPS |
| 67. | CDR-L3 of E2M | artificial | ALWYSNRWV |
| 68. | CDR-H1 of E2M | artificial | GYAMN |
| 69. | CDR-H2 of E2M | artificial | RIRSKYNNYATYYADSVKE |
| 70. | CDR-H3 of E2M | artificial | HRNFGNSYLSWFAY |
| 71. | VH of E2M | artificial | EVQLVESGGGLVQPGGSLKLSCAASGFTFNGYAMNWVRQAPGKGLEWVARIRSKYNNYATYYADSVKERFTISRDDSKN TAYLQMNNLKTEDTAVYYCVRHRNFGNSYLSWFAYWGQGTLVTVSS |
| 72. | VL of E2M | artificial | QTVVTQEPSLTVSPGGTVTLTCRSSTGAVTSGYYPNWVQQKPGQAPRGLIGATDMRPSGTPARFSGSLLGGKAALTLSG VQPEDEAEYYCALWYSNRWVFGGGTKLTVL |

TABLE 30-continued

Sequence Listing

| SEQ ID NO: | Description | Source | Sequence |
|---|---|---|---|
| 73. | VH-VL of E2M | artificial | EVQLVESGGGLVQPGGSLKLSCAASGFTFNGYAMNWVRQAPGKGLEWVARIRSKYNNYATYYADSVKERFTISRDDSKN TAYLQMNNLKTEDTAVYYCVRHRNFGNSYLSWFAYWGQGTLVTVSSGGGGSGGGGSGGGGSQTVVTQEPSLTVSPGGTV TLTCRSSTGAVTSGYYPNWVQQKPGQAPRGLIGATDMRPSGTPARFSGSLLGGKAALTLSGVQPEDEAEYYCALWYSNR WVFGGGTKLTVL |
| 74. | CDR-L1 of F7O | artificial | GSSTGAVTSGYYPN |
| 75. | CDR-L2 of F7O | artificial | GTKFLAP |
| 76. | CDR-L3 of F7O | artificial | ALWYSNRWV |
| 77. | CDR-H1 of F7O | artificial | VYAMN |
| 78. | CDR-H2 of F7O | artificial | RIRSKYNNYATYYADSVKK |
| 79. | CDR-H3 of F7O | artificial | HGNFGNSYISWWAY |
| 80. | VH of F7O | artificial | EVQLVESGGGLVQPGGSLKLSCAASGFTFNVYAMNWVRQAPGKGLEWVARIRSKYNNYATYYADSVKKRFTISRDDSKN TAYLQMNNLKTEDTAVYYCVRHGNFGNSYISWWAYWGQGTLVTVSS |
| 81. | VL of F7O | artificial | QTVVTQEPSLTVSPGGTVTLTCGSSTGAVTSGYYPNWVQQKPGQAPRGLIGGTKFLAPGTPARFSGSLLGGKAALTLSG VQPEDEAEYYCALWYSNRWVFGGGTKLTVL |
| 82. | VH-VL of F7O | artificial | EVQLVESGGGLVQPGGSLKLSCAASGFTFNVYAMNWVRQAPGKGLEWVARIRSKYNNYATYYADSVKKRFTISRDDSKN TAYLQMNNLKTEDTAVYYCVRHGNFGNSYISWWAYWGQGTLVTVSSGGGGSGGGGSGGGGSQTVVTQEPSLTVSPGGTV TLTCGSSTGAVTSGYYPNWVQQKPGQAPRGLIGGTKFLAPGTPARFSGSLLGGKAALTLSGVQPEDEAEYYCALWYSNR WVFGGGTKLTVL |
| 83. | CDR-L1 of F12Q | artificial | GSSTGAVTSGNYPN |
| 84. | CDR-L2 of F12Q | artificial | GTKFLAP |
| 85. | CDR-L3 of F12Q | artificial | VLWYSNRWV |
| 86. | CDR-H1 of F12Q | artificial | SYAMN |
| 87. | CDR-H2 of F12Q | artificial | RIRSKYNNYATYYADSVKG |
| 88. | CDR-H3 of F12Q | artificial | HGNFGNSYVSWWAY |
| 89. | VH of F12Q | artificial | EVQLVESGGGLVQPGGSLKLSCAASGFTFNSYAMNWVRQAPGKGLEWVARIRSKYNNYATYYADSVKGRFTISRDDSKN TAYLQMNNLKTEDTAVYYCVRHGNFGNSYVSWWAYWGQGTLVTVSS |
| 90. | VL of F12Q | artificial | QTVVTQEPSLTVSPGGTVTLTCGSSTGAVTSGNYPNWVQQKPGQAPRGLIGGTKFLAPGTPARFSGSLLGGKAALTLSG VQPEDEAEYYCVLWYSNRWVFGGGTKLTVL |
| 91. | VH-VL of F12Q | artificial | EVQLVESGGGLVQPGGSLKLSCAASGFTFNSYAMNWVRQAPGKGLEWVARIRSKYNNYATYYADSVKGRFTISRDDSKN TAYLQMNNLKTEDTAVYYCVRHGNFGNSYVSWWAYWGQGTLVTVSSGGGGSGGGGSGGGGSQTVVTQEPSLTVSPGGTV TLTCGSSTGAVTSGNYPNWVQQKPGQAPRGLIGGTKFLAPGTPARFSGSLLGGKAALTLSGVQPEDEAEYYCVLWYSNR WVFGGGTKLTVL |
| 92. | CDR-L1 of I2C | artificial | GSSTGAVTSGNYPN |
| 93. | CDR-L2 of I2C | artificial | GTKFLAP |
| 94. | CDR-L3 of I2C | artificial | VLWYSNRWV |
| 95. | CDR-H1 of I2C | artificial | KYAMN |

TABLE 30-continued

Sequence Listing

| SEQ ID NO: | Description | Source | Sequence |
|---|---|---|---|
| 96. | CDR-H2 of I2C | artificial | RIRSKYNNYATYYADSVKD |
| 97. | CDR-H3 of I2C | artificial | HGNFGNSYISYWAY |
| 98. | VH of I2C | artificial | EVQLVESGGGLVQPGGSLKLSCAASGFTFNKYAMNWVRQAPGKGLEWVARIRSKYNNYATYYADSVKDRFTISRDDSKN TAYLQMNNLKTEDTAVYYCVRHGNFGNSYISYWAYWGQGTLVTVSS |
| 99. | VL of I2C | artificial | QTVVTQEPSLTVSPGGTVTLTCGSSTGAVTSGNYPNWVQQKPGQAPRGLIGGTKFLAPGTPARFSGSLLGGKAALTLSG VQPEDEAEYYCVLWYSNRWVFGGGTKLTVL |
| 100. | VH-VL of I2C | artificial | EVQLVESGGGLVQPGGSLKLSCAASGFTFNKYAMNWVRQAPGKGLEWVARIRSKYNNYATYYADSVKDRFTISRDDSKN TAYLQMNNLKTEDTAVYYCVRHGNFGNSYISYWAYWGQGTLVTVSSGGGGSGGGGSGGGGSQTVVTQEPSLTVSPGGTV TLTCGSSTGAVTSGNYPNWVQQKPGQAPRGLIGGTKFLAPGTPARFSGSLLGGKAALTLSGVQPEDEAEYYCVLWYSNR WVFGGGTKLTVL |
| 101. | VH of F12q | artificial | EVQLVESGGGLVQPGGSLRLSCAASGFTFNSYAMNWVRQAPGKGLEWVARIRSKYNNYATYYADSVKGRFTISRDDSKN TAYLQMNSLKTEDTAVYYCVRHGNFGNSYVSWWAYWGQGTLVTVSS |
| 102. | VL of F12q | artificial | QTVVTQEPSLTVSPGGTVTLTCGSSTGAVTSGNYPNWVQQKPGQAPRGLIGGTKFLAPGTPARFSGSLLGGKAALTLSG VQPEDEAEYYCVLWYSNRWVFGGGTKLTVL |
| 103. | F12q scFv | | EVQLVESGGGLVQPGGSLRLSCAASGFTFNSYAMNWVRQAPGKGLEWVARIRSKYNNYATYYADSVKGRFTISRDDSKN TAYLQMNSLKTEDTAVYYCVRHGNFGNSYVSWWAYWGQGTLVTVSSGGGGSGGGGSGGGGSQTVVTQEPSLTVSPGGTV TLTCGSSTGAVTSGNYPNWVQQKPGQAPRGLIGGTKFLAPGTPARFSGSLLGGKAALTLSGVQPEDEAEYYCVLWYSNR WVFGGGTKLTVL |
| 104. | HALB | human | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGKKLVAASQAALGL |
| 105. | HALB7 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAGTFTFHADICTLSEKERQIKKQTALVELVKHKPKATKEQLKAAMDDFAA FVEKCCKADDKETCFAEEGKKLVAASQAALGL |
| 106. | HALB098 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPKLVAASQAALGL |
| 107. | HALB114 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPHLVAASKAALGL |
| 108. | HALB254 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALGVDETYVPKEFNAETFTFHADICTLSEKERQIKKQTALVELVKHKPKATKEQLKAVMDKFAA FVEKCCKADDKETCFAEEGPKLVAASQAALGL |

TABLE 30-continued

Seqence Listing

| SEQ ID NO: | Description | Source | Sequence |
|---|---|---|---|
| 109. | HALB253 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDKFAA FVEKCCKADDKETCFAEEGPKLVAASQAALGL |
| 110. | HALB131 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPHLVAASQAALGL |
| 111. | HALB135 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPHLVAASKAALGL |
| 112. | HALB133 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPKLVAASKAALGL |
| 113. | HALB234 | artificial | DAHKSEVAHRFKDLGEENFKALVLIAFAQYLQQCPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPKLVAASKAALGL |
| 114. | HALB C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGKKLVAASQAALGL |
| 115. | HALB7 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAGTFTFHADICTLSEKERQIKKQTALVELVKHKPKATKEQLKAAMDDFAA FVEKCCKADDKETCFAEEGKKLVAASQAALGL |
| 116. | HALB098 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPKLVAASQAALGL |

TABLE 30-continued

Sequence Listing

| SEQ ID NO: | Description | Source | Sequence |
|---|---|---|---|
| 117. | HALB114 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPHLVAASKAALGL |
| 118. | HALB254 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALGVDETYVPKEFNAETFTFHADICTLSEKERQIKKQTALVELVKHKPKATKEQLKAVMDKFAA FVEKCCKADDKETCFAEEGPKLVAASQAALGL |
| 119. | HALB253 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDKFAA FVEKCCKADDKETCFAEEGPKLVAASQAALGL |
| 120. | HALB131 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPHLVAASQAALGL |
| 121. | HALB135 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPHLVAASKAALGL |
| 122. | HALB133 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPKLVAASKAALGL |
| 123. | HALB234 C34S | artificial | DAHKSEVAHRFKDLGEENFKALVLIAFAQYLQQSPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPKLVAASKAALGL |
| 124. | HALB C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGKKLVAASQAALGL |

TABLE 30-continued

Seqence Listing

| SEQ ID NO: | Description | Source | Sequence |
|---|---|---|---|
| 125. | HALB7 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAGTFTFHADICTLSEKERQIKKQTALVELVKHKPKATKEQLKAAMDDFAA FVEKCCKADDKETCFAEEGKKLVAASQAALGL |
| 126. | HALB098 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPKLVAASQAALGL |
| 127. | HALB114 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPHLVAASKAALGL |
| 128. | HALB254 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALGVDETYVPKEFNAETFTFHADICTLSEKERQIKKQTALVELVKHKPKATKEQLKAVMDKFAA FVEKCCKADDKETCFAEEGPKLVAASQAALGL |
| 129. | HALB253 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDKFAA FVEKCCKADDKETCFAEEGPKLVAASQAALGL |
| 130. | HALB131 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPHLVAASQAALGL |
| 131. | HALB135 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDDFAA FVEKCCKADDKETCFAEEGPHLVAASKAALGL |
| 132. | HALB133 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALEVDETYVPKEFNAETFTFHADICTLSEKERQIKKQTALVELVKHKPKATKEQLKAVMDKFAA FVEKCCKADDKETCFAEEGPKLVAASKAALGL |

TABLE 30-continued

Seqence Listing

| SEQ ID NO: | Description | Source | Sequence |
|---|---|---|---|
| 133. | HALB234 C34A | artificial | DAHKSEVAHRFKDLGEENFKALVLIAFAQYLQQAPFEDHVKLVNEVTEFAKTCVADESAENCDKSLHTLFGDKLCTVAT LRETYGEMADCCAKQEPERNECFLQHKDDNPNLPRLVRPEVDVMCTAFHDNEETFLKKYLYEIARRHPYFYAPELLFFA KRYKAAFTECCQAADKAACLLPKLDELRDEGKASSAKQRLKCASLQKFGERAFKAWAVARLSQRFPKAEFAEVSKLVTD LTKVHTECCHGDLLECADDRADLAKYICENQDSISSKLKECCEKPLLEKSHCIAEVENDEMPADLPSLAADFVESKDVC KNYAEAKDVFLGMFLYEYARRHPDYSVVLLLRLAKTYETTLEKCCAAADPHECYAKVFDEFKPLVEEPQNLIKQNCELF EQLGEYKFQNALLVRYTKKVPQVSTPTLVEVSRNLGKVGSKCCKHPEAKRMPCAEDYLSVVLNQLCVLHEKTPVSDRVT KCCTESLVNRRPCFSALDVDETYVPKEFNAETFTFHADICTLSEKERQIKKQTALVELVKHKPKATKEQLKAVMDDFAA FVEKCCKADDKETCFAEEGPKLVAASKAALGL |
| 134. | Ab156 | artificial | RDWDFDVFGGGTPVGG |
| 135. | linear FcRn binding peptide | artificial | QRFVTGHFGGLXPANG |
| 136. | linear FcRn binding peptide Y | artificial | QRFVTGHFGGLYPANG |
| 137. | linear FcRn binding peptide H | artificial | QRFVTGHFGGLHPANG |
| 138. | core FcRn binding peptide H | artificial | TGHFGGLHP |
| 139. | cyclic FcRn binding peptide H | artificial | QRFCTGHFGGLHPCNG |
| 140. | Cross body 1 HC | | ASTKGPSVFPLAPSSKSTSGGTAALGCLVKDYFPEPVTVSWNSGALTSGVHTFPAVLQSSGLYSLSSVVTVPSSSLGTQ TYICNVNHKPSNTKVDKKVEPKSCDKTHTCPPCPAPELLGGPSVFLEPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYDTTPPVLDSDGSFFLYSDLTVDKSRWQQGNVFSCSVMHEALH NHYTQKSLSLSPGK |
| 141. | Cross body 1 LC | | GQPKAAPSVTLFPPSSEELQANKATLVCLISDFYPGAVTVAWKADSSPVKAGVETTTPSKQSNNKYAASSYLSLTPEQW KSHRSYSCQVTHEGSTVEKTVAPTECSDKTHTCPPCPAPELLGGPSVFLEPPKPKDTLMISRTPEVTCVVVDVSHEDPE VKFNWYVDGVEVHNAKTKPCEEQYGSTYRCVSVLTVLHQDWLNGKEYKCKVSNKALPAPIEKTISKAKGQPREPQVYTL PPSRKEMTKNQVSLTCLVKGFYPSDIAVEWESNGQPENNYKTTPPVLKSDGSFFLYSKLTVDKSRWQQGNVFSCSVMHE ALHNHYTQKSLSLSPGK |
| 142. | Cross body 2 HC | | ASTKGPSVFPLAPCSRSTSESTAALGCLVKDYFPEPVTVSWNSGALTSGVHTFPAVLQSSGLYSLSSVVTVPSSNFGTQ TYTCNVDHKPSNTKVDKTVEPKSSDKTHTCPPCPAPEAAGGPSVFLFPPKPKDTLMISRTPEVTCVVVDVSHEDPEVKF NWYVDGVEVHNAKTKPREEQYNSTYRVVSVLTVLHQDWLNGKEYKCKVSNKALPAPIEKTISKAKGQPREPQVYTLPPS REEMTKNQVSLTCLVKGFYPSDIAVEWESNGQPENNYDTTPPVLDSDGSFFLYSDLTVDKSRWQQGNVFSCSVMHEALH NHYTQKSLSLSPGK |
| 143. | Cross body 2 LC | | GQPKAAPSVTLFPPSSEELQANKATLVCLISDFYPGAVTVAWKADSSPVKAGVETTTPSKQSNNKYAASSYLSLTPEQW KSHRSYSCQVTHEGSTVEKTVAPTECSEPKSSDKTHTCPPCPAPEAAGGPSVFLFPPKPKDTLMISRTPEVTCVVVDVS HEDPEVKFNWYVDGVEVHNAKTKPREEQYNSTYRVVSVLTVLHQDWLNGKEYKCKVSNKALPAPIEKTISKAKGQPREP QVYTLPPSRKEMTKNQVSLTCLVKGFYPSDIAVEWESNGQPENNYKTTPPVLKSDGSFFLYSKLTVDKSRWQQGNVFSC SVMHEALHNHYTQKSLSLSPGK |
| 144. | Hetero-Fc binder Fc | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSRKEMTKNQVSLTCLVKGFYPSDIA VEWESNGQPENNYKTTPPVLKSDGSFFLYSKLTVDKSRWQQGNVFSCSVMHEALHNHYTQKSLSLSPGK |
| 145. | Hetero-Fc partner Fc | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSREEMTKNQVSLTCLVKGFYPSDIA VEWESNGQPENNYDTTPPVLDSDGSFFLYSDLTVDKSRWQQGNVFSCSVMHEALHNHYTQKSLSLSPGK |

TABLE 30-continued

Seqence Listing

| SEQ ID NO: | Description | Source | Sequence |
|---|---|---|---|
| 146. | Maxibody 1 target Fc | | EPKSSDKTHTCPPCPAPELLGGPSVFLFPPKPKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQPREPQVYTLPPSRKEMTKNQVSLTCLVKGFY PSDIAVEWESNGQPENNYKTTPPVLKSDGSFFLYSKLTVDKSRWQQGNVFSCSVMHEALHNHYTQKSLSLSPGK |
| 147. | Maxibody 1 CD3 Fc | | EPKSSDKTHTCPPCPAPELLGGPSVFLFPPKPKDTLMISRTPEVTCVVVDVSHEDPEVKFNWYVDGVEVHNAKTKPCEE QYGSTYRCVSVLTVLHQDWLNGKEYKCKVSNKALPAPIEKTISKAKGQPREPQVYTLPPSREEMTKNQVSLTCLVKGFY PSDIAVEWESNGQPENNYDTTPPVLDSDGSFFLYSDLTVDKSRWQQGNVFSCSVMHEALHNHYTQKSLSLSPGK |
| 148. | Maxibody 2 target Fc | | EPKSSDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSRKEMTKNQVSLTCLVKGFY PSDIAVEWESNGQPENNYKTTPPVLKSDGSFFLYSKLTVDKSRWQQGNVFSCSVMHEALHNHYTQKSLSLSPGK |
| 149. | Maxibody 2 CD3 Fc | | EPKSSDKTHTCPPCPAPEAAGGPSVFLFPPKPKDTLMISRTPEVTCVVVDVSHEDPEVKFNWYVDGVEVHNAKTKPREE QYNSTYRVVSVLTVLHQDWLNGKEYKCKVSNKALPAPIEKTISKAKGQPREPQVYTLPPSREEMTKNQVSLTCLVKGFY PSDIAVEWESNGQPENNYDTTPPVLDSDGSFFLYSDLTVDKSRWQQGNVFSCSVMHEALHNHYTQKSLSLSPGK |
| 150. | Mono Fc | | APELLGGPSVFLFPPKPKDTLMISRTPEVTCVVVDVSHEDPEVKFNWYVDGVEVHNAKTKPREEQYNSTYRVVSVLTVL HQDWLNGKEYKCKVSNKALPAPIEKTISKAKGQPREPQVYTLPPSREEMTKNQVSLTCLVKGFYPSDIAVEWESNGQPE NNYDTTPPVLDSDGSFFLYSDLTVDKSRWQQGNVFSCSVMHEALHNHYTQKSLSLSPGK |
| 151. | MS_1 | VH CDR1 | SSSYYWG |
| 152. | MS_1 | VH CDR2 | SIYYSGITNYNPSLKS |
| 153. | MS_1 | VH CDR3 | PSNYDAFDI |
| 154. | MS_1 | VL CDR1 | TGSSSNIGAGYDVH |
| 155. | MS_1 | VL CDR2 | GNSKRPS |
| 156. | MS_1 | VL CDR3 | QSYDSSLGGWV |
| 157. | MS_1 | VH | QVQLQESGPGLVKPSETLSLTCTVSGGSISSSSYYWGWIRQPPGKGLEWIGSIYYSGITNYNPSLKSRVTISVDTSKNQ FSLKLSSVTAADTAVYYCARPSNYDAFDIWGQGTMVTVSS |
| 158. | MS_1 | VL | QSVLTQPPSVSGAPGQRVTISCTGSSSNIGAGYDVHWYQQVPGTAPKLLIYGNSKRPSGVPDRFSGSKSGTSASLAITG LQAEDEADYYCQSYDSSLGGWVFGGGTKLTVL |
| 159. | MS_1 | scFv | QVQLQESGPGLVKPSETLSLTCTVSGGSISSSSYYWGWIRQPPGKGLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG GGTKLTVL |
| 160. | MS_1 | bi-specific molecule | QVQLQESGPGLVKPSETLSLTCTVSGGSISSSSYYWGWIRQPPGKGLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG GGTKLTVLSGGGGSEVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKAALTSGVQPE DEAEYYCVLWYSNRWVFGGGTKLTVL |
| 161. | MS_2 | VH CDR1 | DHYMS |
| 162. | MS_2 | VH CDR2 | YISSSGSTIYYADSVKG |
| 163. | MS_2 | VH CDR3 | DLGPSFDY |
| 164. | MS_2 | VL CDR1 | RASQGISSWLA |
| 165. | MS_2 | VL CDR2 | AASRLQS |
| 166. | MS_2 | VL CDR3 | QQANSFPRT |
| 167. | MS_2 | VH | QVQLVESGGGVVQPGRSLRLSCAASGFTFSDHYMSWIRQTPGKGLEWVSYISSSGSTIYYADSVKGRFTISRDNAKNSL YLQMNSLRAEDTAVYYCARDLGPSFDYWGQGSLVTVSS |
| 168. | MS_2 | VL | DIQMTQSPSSVSASVGDRVTITCRASQGISSWLAWYQQKPGKAPKLLIDAASRLQSGVPSRFSGSGSGTDFTLTISSLQ PEDFATYYCQQANSFPRTFGQGTKVEIK |

TABLE 30-continued

Sequence Listing

| SEQ ID NO: | Description | Source | Sequence |
|---|---|---|---|
| 169. | MS_2 | scFv | QVQLVESGGGVVQPGRSLRLSCAASGFTFSDHYMSWIRQTPGKGLEWVSYISSSGSTIYYADSVKGRFTISRDNAKNSL<br>YLQMNSLRAEDTAVYYCARDLGPSFDYWGQGSLVTVSSGGGGSGGGGSGGGGSDIQMTQSPSSVSASVGDRVTITCRAS<br>QGISSWLAWYQQKPGKAPKLLIDAASRLQSGVPSRFSGSGSGTDFTLTISSLQPEDFATYYCQQANSFPRTFGQGTKVE<br>IK |
| 170. | MS_2 | bi-specific molecule | QVQLVESGGGVVQPGRSLRLSCAASGFTFSDHYMSWIRQTPGKGLEWVSYISSSGSTIYYADSVKGRFTISRDNAKNSL<br>YLQMNSLRAEDTAVYYCARDLGPSFDYWGQGSLVTVSSGGGGSGGGGSGGGGSDIQMTQSPSSVSASVGDRVTITCRAS<br>QGISSWLAWYQQKPGKAPKLLIDAASRLQSGVPSRFSGSGSGTDFTLTISSLQPEDFATYYCQQANSFPRTFGQGTKVE<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVL |
| 171. | MS_3 | VH CDR1 | DYYMT |
| 172. | MS_3 | VH CDR2 | YISSSGSTIYYADSVKG |
| 173. | MS_3 | VH CDR3 | DRNSHFDY |
| 174. | MS_3 | VL CDR1 | RASQGITRWLA |
| 175. | MS_3 | VL CDR2 | AASVLQS |
| 176. | MS_3 | VL CDR3 | QQSNSFPRT |
| 177. | MS_3 | VH | QVQLVESGGGLVKPGGSLRLSCAASGFTFSDYYMTWIRQAPGKGLEWISYISSSGSTIYYADSVKGRFTISRDNAKNSL<br>YLQMNSLRAEDTAVYYCARDRNSHFDYWGQGTLVTVSS |
| 178. | MS_3 | VL | DIQMTQSPSSVSASVGDRVTITCRASQGITRWLAWYQQKPGKAPKLLIYAASVLQSGVPSRFSGSGSGTDFTLTISSLQ<br>PEDFATYYCQQSNSFPRTFGQGTKVEIK |
| 179. | MS_3 | scFv | QVQLVESGGGLVKPGGSLRLSCAASGFTFSDYYMTWIRQAPGKGLEWISYISSSGSTIYYADSVKGRFTISRDNAKNSL<br>YLQMNSLRAEDTAVYYCARDRNSHFDYWGQGTLVTVSSGGGGSGGGGSGGGGSDIQMTQSPSSVSASVGDRVTITCRAS<br>QGITRWLAWYQQKPGKAPKLLIYAASVLQSGVPSRFSGSGSGTDFTLTISSLQPEDFATYYCQQSNSFPRTFGQGTKVE<br>IK |
| 180. | MS_3 | bi-specific molecule | QVQLVESGGGLVKPGGSLRLSCAASGFTFSDYYMTWIRQAPGKGLEWISYISSSGSTIYYADSVKGRFTISRDNAKNSL<br>YLQMNSLRAEDTAVYYCARDRNSHFDYWGQGTLVTVSSGGGGSGGGGSGGGGSDIQMTQSPSSVSASVGDRVTITCRAS<br>QGITRWLAWYQQKPGKAPKLLIYAASVLQSGVPSRFSGSGSGTDFTLTISSLQPEDFATYYCQQSNSFPRTFGQGTKVE<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVL |
| 181. | MS_4 | VH CDR1 | DYYMT |
| 182. | MS_4 | VH CDR2 | YISSSGSTIYYADSVKG |
| 183. | MS_4 | VH CDR3 | DRNSHFDY |
| 184. | MS_4 | VL CDR1 | RASQGINTWLA |
| 185. | MS_4 | VL CDR2 | GASGLQS |
| 186. | MS_4 | VL CDR3 | QQAKSFPRT |
| 187. | MS_4 | VH | QVQLVESGGGLVKPGGSLRLSCAASGFTFSDYYMTWIRQAPGKGLEWLSYISSSGSTIYYADSVKGRFTISRDNAKNSL<br>FLQMNSLRAEDTAVYYCARDRNSHFDYWGQGTLVTVSS |
| 188. | MS_4 | VL | DIQMTQSPSSVSASVGDRVTITCRASQGINTWLAWYQQKPGKAPKLLIYGASGLQSGVPSRFSGSGSGTDFTLTISSLQ<br>PEDFATYYCQQAKSFPRTFGQGTKVEIK |
| 189. | MS_4 | scFv | QVQLVESGGGLVKPGGSLRLSCAASGFTFSDYYMTWIRQAPGKGLEWLSYISSSGSTIYYADSVKGRFTISRDNAKNSL<br>FLQMNSLRAEDTAVYYCARDRNSHFDYWGQGTLVTVSSGGGGSGGGGSGGGGSDIQMTQSPSSVSASVGDRVTITCRAS<br>QGINTWLAWYQQKPGKAPKLLIYGASGLQSGVPSRFSGSGSGTDFTLTISSLQPEDFATYYCQQAKSFPRTFGQGTKVE<br>IK |
| 190. | MS_4 | bi-specific molecule | QVQLVESGGGLVKPGGSLRLSCAASGFTFSDYYMTWIRQAPGKGLEWLSYISSSGSTIYYADSVKGRFTISRDNAKNSL<br>FLQMNSLRAEDTAVYYCARDRNSHFDYWGQGTLVTVSSGGGGSGGGGSGGGGSDIQMTQSPSSVSASVGDRVTITCRAS<br>QGINTWLAWYQQKPGKAPKLLIYGASGLQSGVPSRFSGSGSGTDFTLTISSLQPEDFATYYCQQAKSFPRTFGQGTKVE<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVL |

TABLE 30-continued

Sequence Listing

| SEQ ID NO: | Description | Source | Sequence |
|---|---|---|---|
| 191. | MS_5 | VH CDR1 | DHYMS |
| 192. | MS_5 | VH CDR2 | YISSSGGIIYYADSVKG |
| 193. | MS_5 | VH CDR3 | DVGSHFDY |
| 194. | MS_5 | VL CDR1 | RASQDISRWLA |
| 195. | MS_5 | VL CDR2 | AASRLQS |
| 196. | MS_5 | VL CDR3 | QQAKSFPRT |
| 197. | MS_5 | VH | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSS |
| 198. | MS_5 | VL | DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK |
| 199. | MS_5 | scFv | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK |
| 200. | MS_5 | bi-specific molecule | QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 201. | MS_6 | VH CDR1 | DHYMS |
| 202. | MS_6 | VH CDR2 | YISNSGSIIYYVDSVKG |
| 203. | MS_6 | VH CDR3 | DVRTAFDY |
| 204. | MS_6 | VL CDR1 | RASQSIGSWLA |
| 205. | MS_6 | VL CDR2 | AASSLQS |
| 206. | MS_6 | VL CDR3 | QQANSFPRT |
| 207. | MS_6 | VH | QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSS |
| 208. | MS_6 | VL | DIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK |
| 209. | MS_6 | scFv | QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK |
| 210. | MS_6 | bi-specific molecule | QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL |
| 211. | MS_7 | VH CDR1 | SKFMT |
| 212. | MS_7 | VH CDR2 | VIYSGGKTYYADSVKG |
| 213. | MS_7 | VH CDR3 | DSGGWGYFDY |
| 214. | MS_7 | VL CDR1 | KSSQSVLYSSNNKNYLA |
| 215. | MS_7 | VL CDR2 | WASTRES |
| 216. | MS_7 | VL CDR3 | QQYYSTPPT |

TABLE 30-continued

Seqence Listing

| SEQ ID NO: | Description | Source | Sequence |
|---|---|---|---|
| 217. | MS_7 | VH | EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTSS |
| 218. | MS_7 | VL | DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK |
| 219. | MS_7 | scFv | EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK |
| 220. | MS_7 | bispecific molecule | EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTSSGGGGSGGGGSGGGGSQTVVTQEPSLTVSPGGTVTLTCGSSTGAVTSGNYPNWVQQKPGQAPRGLIGGTKFLAPGTPARFSGSLLGKAALTLSGVQPEDEAEYYCVLWYSNRWVFGGGTKLTVL |
| 221. | MS_8 | VH CDR1 | SYYWN |
| 222. | MS_8 | VH CDR2 | RIYYNGNTYYNPSLKS |
| 223. | MS_8 | VH CDR3 | PKLGIDAFDI |
| 224. | MS_8 | VL CDR1 | TGSSSNIGAGYDVH |
| 225. | MS_8 | VL CDR2 | GNSNRPS |
| 226. | MS_8 | VL CDR3 | QSYDSSLSGWV |
| 227. | MS_8 | VH | QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSS |
| 228. | MS_8 | VL | QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL |
| 229. | MS_8 | scFv | QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL |
| 230. | MS_8 | bispecific molecule | QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLSGGGGSEVQLVESGGGLVQPGGSLKLSCAASGFTENKYAMNWVRQAPGKGLEWVARIRSKYNNYATYYADSVKDRFTISRDDSKNTAYLQMNNLKTEDTAVYYCVRHGNEGNSYISYWAYWGQGTLVTSSGGGGSGGGGSGGGGSQTVVTQEPSLTVSPGGTVTLTCGSSTGAVTSGNYPNWVQQKPGQAPRGLIGGTKFLAPGTPARFSGSLLGKAALTLSGVQPEDEAEYYCVLWYSNRWVFGGGTKLTVL |
| 231. | Human MSLN v1 NM_005823 | human | MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQQGGIPNGYLVLDLSMQEALSGTPCLLGPGPVLTVLALLLASTLA |
| 232. | Human MSLN v2 NM_013404 | human | MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQQGGIPNGYLVLDLSMQEALSGTPCLLGPGPVLTVLALLLASTLA |
| 233. | Human MSLN v6 AY743922 | human | MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTHFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETL |

TABLE 30-continued

Sequence Listing

| SEQ ID NO: | Description | Source | Sequence |
|---|---|---|---|
| | | | KALLEVNKGHEMSPQVATLIDRFVKGRGQLDKDTLDTLTAFYPGYLCSLSPEELSSVPPSSIWAVRPQDLDTCDPRQLD<br>VLYPKARLAFQNMNGSEYFVKIQSFLGGAPTEDLKALSQQNVSMDLATFMKLRTDAVLPLTVAEVQKLLGPHVEGLKAE<br>ERHRPVRDWILRQRQDDLDTLGLGLQGGIPNGYLVLDLSVQEALSGTPCLLGPGPVLTVLALLLASTLA |
| 234. | cyno MSLN v1 LMR C52457 | macaque | MALPMARPLSGSCGTPALGSLLFLLFSLGWVQPSRVLAGETRQEAAPLDGILTNAPDIASLSPRQLLGFTCVEVSGLST<br>ELVQELAVALGQKNVKLSAEQLRCLAHRLSEPPEDLDALPLDLLLFLNPDAFSGPQACTHFFSRVAKANVDLLPRGAPE<br>RQRLLPAALTCWGVRGSLLSEADVRALGGLACDLPGRFVAESAEVVLPRLVRCLGPLDQDQQEAARAALQRGGPPYGPP<br>STWSISTLDDLQSLLPVLGQPVIHSIPQGILAAWRQRSSRDPSWQQPEQTVLRPPRFRRDVERTTCPPEKEVHEIDENLI<br>FYKKRELEACVDAALLAAQMDRVDAIPFTYEQLDVLHKHLDELYPQGYPESVIRHLGHLFLKMSPEDIRKWNVTSLETL<br>KALLKVSKGHEMSAQVATLIDRVVVGRGQLDKDTADTLTAFCPGCLCSLSPERLSSVPPSVIGAVRPQDLDTCGPRQLD<br>VLYPKARLAFQNMSGSEYFVKIRPFLGGAPTEDLKALSQQNVSMDLATFMKLRREAVLPLTVAEVQKLLGPHVEGLKVE<br>EQHSPVRDWILKQRQDDLDTLGLGLQGGIPNGYLILDLSVREALSGTPCLLGPGPVLTILALLLASTLA |
| 235. | Mega-karyocyte-potenti-ating factor NM_005823 | human | MALPTARPLLGSCGTPALGSLLFLLFSLGWVQPSRTLAGETGQEAAPLDGVLANPPNISSLSPRQLLGFPCAEVSGLST<br>ERVRELAVALAQKNVKLSTEQLRCLAHRLSEPPEDLDALPLDLLLFLNPDAFSGPQACTRFFSRITKANVDLLPRGAPE<br>RQRLLPAALACWGVRGSLLSEADVRALGGLACDLPGRFVAESAEVLLPRLVSCPGPLDQDQQEAARAALQGGGPPYGPP<br>STWSVSTMDALRGLLPVLGQPIIRSIPQGIVAAWRQRSSRDPSWRQPER |
| 236. | MSLN. cleaved form NM_005823 | human | EVEKTACPSGKKAREIDESLIFYKKWELEACVDAALLATQMDRVNAIPFTYEQLDVLKHKLDELYPQGYPESVIQHLGY<br>LFLKMSPEDIRKWNVTSLETLKALLEVNKGHEMSPQVATLIDRFVKGRGQLDKDTLDTLTAFYPGYLCSLSPEELSSVP<br>PSSIWAVRPQDLDTCDPRQLDVLYPKARLAFQNMNGSEYFVKIQSFLGGAPTEDLKALSQQNVSMDLATFMKLRTDAVL<br>PLTVAEVQKLLGPHVEGLKAEERHRPVRDWILRQRQDDLDTLGLGLQGGIPNGYLVLDLSMQEALS |
| 237. | C-terminal cleavage NM_005823 | human | GTPCLLGPGPVLTVLALLLASTLA |
| 238. | MSLN-E 1 | human | EVEKTACPSGKKAREIDESLIFYKKWELEACVDAALLATQMDRVNAIPFTY |
| 239. | MSLN-E 2 | human | EQLDVLKHKLDELYPQGYPESVIQHLGYLFLKMSPEDI |
| 240. | MSLN-E 3 | human | RKWNVTSLETLKALLEVNKGHEMSPQVATLIDRFVKGRGQLDKDTLDTLTAFYPGYLCSLSPEELSSVP |
| 241. | MSLN-E 4 | human | PSSIWAVRPQDLDTCDPRQLDVLYPKARLAFQNMNGSEYFVKIQSFLG |
| 242. | MSLN-E 5 | human | GAPTEDLKALSQQNVSMDLATFMKLRTDAVLPLTVAEVQKLLGP |
| 243. | MSLN-E 6 | human | HVEGLKAEERHRPVRDWILRQRQDDLDTLGLGLQGGIPNGYLVLDLSMQEAL |
| 244. | MSLN-E 1 + 2 | human | EVEKTACPSGKKAREIDESLIFYKKWELEACVDAALLATQMDRVNAIPFTYEQLDVLKHKLDELYPQGYPESVIQHLGY<br>LFLKMSPEDI |
| 245. | MSLN-E 2 + 3 | human | EQLDVLKHKLDELYPQGYPESVIQHLGYLFLKMSPEDIRKWNVTSLETLKALLEVNKGHEMSPQVATLIDRFVKGRGQL<br>DKDTLDTLTAFYPGYLCSLSPEELSSVP |
| 246. | hu orl MSLN-E1 mu | artificial | MALPTARPLLGSCGTPALGSLLFLLFSLGWVQPSRTLAGETGQEAAPLDGVLANPPNISSLSPRQLLGFPCAEVSGLST<br>ERVRELAVALAQKNVKLSTEQLRCLAHRLSEPPEDLDALPLDLLLFLNPDAFSGPQACTRFFSRITKANVDLLPRGAPE<br>RQRLLPAALACWGVRGSLLSEADVRALGGLACDLPGRFVAESAEVLLPRLVSCPGPLDQDQQEAARAALQGGGPPYGPP<br>STWSVSTMDALRGLLPVLGQPIIRSIPQGIVAAWRQRSSRDPSWRQPERTILRPRFRRDAEQKACPPGKEPYKVDEDLI<br>FYQNWELEACVDGTMLARQMDLVNEIPFTYEQLDVLKHKLDELYPQGYPESVIQHLGYLFLKMSPEDIRKWNVTSLETL<br>KALLEVNKGHEMSPQVATLIDRFVKGRGQLDKDTLDTLTAFYPGYLCSLSPEELSSVPPSSIWAVRPQDLDTCDPRQLD<br>VLYPKARLAFQNMNGSEYFVKIQSFLGGAPTEDLKALSQQNVSMDLATFMKLRTDAVLPLTVAEVQKLLGPHVEGLKAE<br>ERHRPVRDWILRQRQDDLDTLGLGLQGGIPNGYLVLDLSMQEALSGTPCLLGPGPVLTVLALLLASTLA |
| 247. | hu orl MSLN-E2 mu | artificial | MALPTARPLLGSCGTPALGSLLFLLFSLGWVQPSRTLAGETGQEAAPLDGVLANPPNISSLSPRQLLGFPCAEVSGLST<br>ERVRELAVALAQKNVKLSTEQLRCLAHRLSEPPEDLDALPLDLLLFLNPDAFSGPQACTRFFSRITKANVDLLPRGAPE<br>RQRLLPAALACWGVRGSLLSEADVRALGGLACDLPGRFVAESAEVLLPRLVSCPGPLDQDQQEAARAALQGGGPPYGPP<br>STWSVSTMDALRGLLPVLGQPIIRSIPQGIVAAWRQRSSRDPSWRQPERTILRPRFRREVEKTACPSGKKAREIDESLI<br>FYKKWELEACVDAALLATQMDRVNAIPFTYQGYPESLIQQLGHFFRYVSPEDIRKWNVTSLETL<br>KALLEVNKGHEMSPQVATLIDRFVKGRGQLDKDTLDTLTAFYPGYLCSLSPEELSSVPPSSIWAVRPQDLDTCDPRQLD<br>VLYPKARLAFQNMNGSEYFVKIQSFLGGAPTEDLKALSQQNVSMDLATFMKLRTDAVLPLTVAEVQKLLGPHVEGLKAE<br>ERHRPVRDWILRQRQDDLDTLGLGLQGGIPNGYLVLDLSMQEALSGTPCLLGPGPVLTVLALLLASTLA |
| 248. | hu orl MSLN-E3 mu | artificial | MALPTARPLLGSCGTPALGSLLFLLFSLGWVQPSRTLAGETGQEAAPLDGVLANPPNISSLSPRQLLGFPCAEVSGLST<br>ERVRELAVALAQKNVKLSTEQLRCLAHRLSEPPEDLDALPLDLLLFLNPDAFSGPQACTRFFSRITKANVDLLPRGAPE<br>RQRLLPAALACWGVRGSLLSEADVRALGGLACDLPGRFVAESAEVLLPRLVSCPGPLDQDQQEAARAALQGGGPPYGPP<br>STWSVSTMDALRGLLPVLGQPIIRSIPQGIVAAWRQRSSRDPSWRQPERTILRPRFRRREVEKTACPSGKKAREIDESLI<br>FYKKWELEACVDAALLATQMDRVNAIPFTYEQLDVLKHKLDELYPQGYPESVIQHLGYLFLKMSPEDIHQWNVTSPDTV<br>KTLLKVSKGQKMNAQAIALVACYLRGGGQLDEDMVKALGDIPLSYLCDFSPQDLHSVPPSSIWAVRPQDLDTCDPRQLD<br>VLYPKARLAFQNMNGSEYFVKIQSFLGGAPTEDLKALSQQNVSMDLATFMKLRTDAVLPLTVAEVQKLLGPHVEGLKAE<br>ERHRPVRDWILRQRQDDLDTLGLGLQGGIPNGYLVLDLSMQEALSGTPCLLGPGPVLTVLALLLASTLA |

TABLE 30-continued

Seqence Listing

| SEQ ID NO: | Description | Source | Sequence |
|---|---|---|---|
| 249. | hu orl MSLN-E4 mu | artificial | MALPTARPLLGSCGTPALGSLLFLLFSLGWVQPSRTLAGETGQEAAPLDGVLANPPNISSLSPRQLLGFPCAEVSGLST ERVRELAVALAQKNVKLSTEQLRCLAHRLSEPPEDLDALPLDLLLFLNPDAFSGPQACTRFFSRITKANVDLLPRGAPE RQRLLPAALACWGVRGSLLSEADVRALGGLACDLPGRFVAESAEVLLPRLVSCPGPLDQDQQEAARAALQGGGPPYGPP STWSVSTMDALRGLLPVLGQPIIRSIPQGIVAAWRQSSRDPSWRQPERTILRPRFRREVEKTACPSGKKAREIDESLI FYKKWELEACVDAALLATQMDRVNAIPFTYEQLDVLKHKLDELYPQGYPESVIQHLGYLFLKMSPEDIRKWNVTSLETL KALLEVNKGHEMSPQVATLIDRFVKGRGQLDKDTLDTLTAFYPGYLCSLSPEELSSVPSSVMWLVGPQDLDKCSQRHLG LLYQKACSAFQNVSGLEYFEKIKTFLGGAPTEDLKALSQQNVSMDLATFMKLRTDAVLPLTVAEVQKLLGPHVEGLKAE ERHRPVRDWILRQRQDDLDTLGLGLQGGIPNGYLVLDLSMQEALSGTPCLLGPGPVLTVALLLASTLA |
| 250. | hu orl MSLN-E5 mu | artificial | MALPTARPLLGSCGTPALGSLLFLLFSLGWVQPSRTLAGETGQEAAPLDGVLANPPNISSLSPRQLLGFPCAEVSGLST ERVRELAVALAQKNVKLSTEQLRCLAHRLSEPPEDLDALPLDLLLFLNPDAFSGPQACTRFFSRITKANVDLLPRGAPE RQRLLPAALACWGVRGSLLSEADVRALGGLACDLPGRFVAESAEVLLPRLVSCPGPLDQDQQEAARAALQGGGPPYGPP STWSVSTMDALRGLLPVLGQPIIRSIPQGIVAAWRQSSRDPSWRQPERTILRPRFRREVEKTACPSGKKAREIDESLI FYKKWELEACVDAALLATQMDRVNAIPFTYEQLDVLKHKLDELYPQGYPESVIQHLGYLFLKMSPEDIRKWNVTSLETL KALLEVNKGHEMSPQVATLIDRFVKGRGQLDKDTLDTLTAFYPGYLCSLSPEELSSVPPSSIWAVRPQDLDTCDPRQLD VLYPKARLAFQNMNGSEYFVKIQSFLGGASVKDLRALSQHNVSMDIATFKRLQVDSLVGLSVAEVQKLLGPHVEGLKAE ERHRPVRDWILRQRQDDLDTLGLGLQGGIPNGYLVLDLSMQEALSGTPCLLGPGPVLTVALLLASTLA |
| 251. | hu orl MSLN-E6 mu | artificial | MALPTARPLLGSCGTPALGSLLFLLFSLGWVQPSRTLAGETGQEAAPLDGVLANPPNISSLSPRQLLGFPCAEVSGLST ERVRELAVALAQKNVKLSTEQLRCLAHRLSEPPEDLDALPLDLLLFLNPDAFSGPQACTRFFSRITKANVDLLPRGAPE RQRLLPAALACWGVRGSLLSEADVRALGGLACDLPGRFVAESAEVLLPRLVSCPGPLDQDQQEAARAALQGGGPPYGPP STWSVSTMDALRGLLPVLGQPIIRSIPQGIVAAWRQSSRDPSWRQPERTILRPRFRREVEKTACPSGKKAREIDESLI FYKKWELEACVDAALLATQMDRVNAIPFTYEQLDVLKHKLDELYPQGYPESVIQHLGYLFLKMSPEDIRKWNVTSLETL KALLEVNKGHEMSPQVATLIDRFVKGRGQLDKDTLDTLTAFYPGYLCSLSPEELSSVPPSSIWAVRPQDLDTCDPRQLD VLYPKARLAFQNMNGSEYFVKIQSFLGGAPTEDLKALSQQNVSMDLATFMKLRTDAVLPLTVAEVQKLLGPNIVDLKTE EDKSPVRDWLFRQHQKDLDRLGLGLQGGIPNGYLVLDFNVREAFSGTPCLLGPGPVLTVALLLASTLA |
| 252. | Fc monomer-1 +c/-g | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGK |
| 253. | Fc monomer-2 +c/-g/delGK | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSP |
| 254. | Fc monomer-3 -c/+g | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGK |
| 255. | Fc monomer-4 -c/+g/delGK | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSP |
| 256. | Fc monomer-5 -c/-g | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGK |
| 257. | Fc monomer-6 -c/-g/delGK | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSP |
| 258. | Fc monomer-7 +c/+g | | DKTHTCPPCPAPELLGGPSVFLFPPKPKDTLMISRTPEVTCVVVDVSHEDPEVKFNWYVDGVEVHNAKTKPCEEQYNST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGK |
| 259. | Fc monomer-8 +c/+g/delGK | | DKTHTCPPCPAPELLGGPSVFLFPPKPKDTLMISRTPEVTCVVVDVSHEDPEVKFNWYVDGVEVHNAKTKPCEEQYNST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSP |
| 260. | scFc-1 | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGKGGGGSGGGGS GGGGSGGGGSGGGGSDKTHTCPPCPAPELLGGPSVFLFPPKPKDTLMISRTPEVTCVVVDVSHEDPEVKFNWYV DGVEVHNAKTKPCEEQYGSTYRCVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQQGNVFSCSVMHEALHNHYT QKSLSLSPGK |
| 261. | scFc-2 | | DKTHTCPPCPAPELLGGPSVFLFPPKPKDTLMISRTPEVTCVVVDVSHEDPEVKFNWYVDGVEVHNAKTKPCEEQYGST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGGGGSGGGGSGG GGSGGGGSGGGGSDKTHTCPPCPAPELLGGPSVFLFPPKPKDTLMISRTPEVTCVVVDVSHEDPEVKFNWYVDG VEVHNAKTKPCEEQYGSTYRCVSVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRWQQGNVFSCSVMHEALHNHYTQK SLSLSP |

TABLE 30-continued

Sequence Listing

| SEQ ID NO: | Description | Source | Sequence |
|---|---|---|---|
| 262. | scFc-3 | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGKGGGGSGGGGS GGGGSGGGGSGGGGSGGGGSDKTHTCPPCPAPELLGGPSVFLFPPKPKDTLMISRTPEVTCVVVDVSHEDPEVKFNWYV DGVEVHNAKTKPREEQYNSTYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQQGNVFSCSVMHEALHNHYT QKSLSLSPGK |
| 263. | scFc-4 | | DKTHTCPPCPAPELLGGPSVFLFPPKPKDTLMISRTPEVTCVVVDVSHEDPEVKFNWYVDGVEVHNAKTKPREEQYNST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGGGGSGGGGSGG GGSGGGGSGGGGSGGGGSDKTHTCPPCPAPELLGGPSVFLFPPKPKDTLMISRTPEVTCVVVDVSHEDPEVKFNWYVDG VEVHNAKTKPREEQYNSTYRVVSVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRWQQGNVFSCSVMHEALHNHYTQK SLSLSP |
| 264. | scFc-5 | | DKTHTCPPCPAPELLGGPSVFLFPPKPKDTLMISRTPEVTCVVVDVSHEDPEVKFNWYVDGVEVHNAKTKPREEQYGST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGKGGGGSGGGGS GGGGSGGGGSGGGGSGGGGSDKTHTCPPCPAPELLGGPSVFLFPPKPKDTLMISRTPEVTCVVVDVSHEDPEVKFNWYV DGVEVHNAKTKPREEQYGSTYRVVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQQGNVFSCSVMHEALHNHYT QKSLSLSPGK |
| 265. | scFc-6 | | DKTHTCPPCPAPELLGGPSVFLFPPKPKDTLMISRTPEVTCVVVDVSHEDPEVKFNWYVDGVEVHNAKTKPREEQYGST YRVVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGGGGSGGGGSGG GGSGGGGSGGGGSGGGGSDKTHTCPPCPAPELLGGPSVFLFPPKPKDTLMISRTPEVTCVVVDVSHEDPEVKFNWYVDG VEVHNAKTKPREEQYGSTYRVVSVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRWQQGNVFSCSVMHEALHNHYTQK SLSLSP |
| 266. | scFc-7 | | DKTHTCPPCPAPELLGGPSVFLFPPKPKDTLMISRTPEVTCVVVDVSHEDPEVKFNWYVDGVEVHNAKTKPCEEQYNST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGKGGGGSGGGGS GGGGSGGGGSGGGGSGGGGSDKTHTCPPCPAPELLGGPSVFLFPPKPKDTLMISRTPEVTCVVVDVSHEDPEVKFNWYV DGVEVHNAKTKPCEEQYNSTYRCVSVLTVLHQDWLNGKEYKCKVSNKALPAPIEKTISKAKGQPREPQVYTLPPSREEM TKNQVSLTCLVKGFYPSDIAVEWESNGQPENNYKTTPPVLDSDGSFFLYSKLTVDKSRWQQGNVFSCSVMHEALHNHYT QKSLSLSPGK |
| 267. | scFc-8 | | DKTHTCPPCPAPELLGGPSVFLFPPKPKDTLMISRTPEVTCVVVDVSHEDPEVKFNWYVDGVEVHNAKTKPCEEQYNST YRCVSVLTVLHQDWLNGKEYKCKVSNKALPAPIEKTISKAKGQPREPQVYTLPPSREEMTKNQVSLTCLVKGFYPSDIA VEWESNGQPENNYKTTPPVLDSDGSFFLYSKLTVDKSRWQQGNVFSCSVMHEALHNHYTQKSLSLSPGGGGSGGGGSGG GGSGGGGSGGGGSGGGGSDKTHTCPPCPAPELLGGPSVFLFPPKPKDTLMISRTPEVTCVVVDVSHEDPEVKFNWYVDG VEVHNAKTKPCEEQYNSTYRCVSVLTVLHQDWLNGKEYKCKVSNKALPAPIEKTISKAKGQPREPQVYTLPPSREEMTK NQVSLTCLVKGFYPSDIAVEWESNGQPENNYKTTPPVLDSDGSFFLYSKLTVDKSRWQQGNVFSCSVMHEALHNHYTQK SLSLSP |
| 268. | MS_1xCD3-scFc | Bispecific HLE molecule | QVQLQESGPGLVKPSETLSLTCTVSGGSISSSSYYWGWIRQPPGKGLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG GGTKLTVLSGGGGSEVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHE DPEVKFNWYVDGVEVHNAKTKPCEEQYNSTYRCVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGKGGGGSGGGGSGGGGSGGGGSGGGGSGGGGSDKTHTCPPCPAPELLGGPSVFLFPPKPKD TLMISRTPEVTCVVVDVSHEDPEVKFNWYVDGVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSDIAVEWESNGQPENNYKTTPPVLDSDGSFFLY SKLTVDKSRWQQGNVFSCSVMHEALHNHYTQKSLSLSPGK |
| 269. | MS_1xCD3-scFc_delGK | Bispecific HLE molecule | QVQLQESGPGLVKPSETLSLTCTVSGGSISSSSYYWGWIRQPPGKGLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG GGTKLTVLSGGGGSEVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGGGGSGGGGSGGGGSGGGGSGGGGSGGGGSDKTHTCPPCPAPELLGGPSVFLFPPKPKDTL MISRTPEVTCVVVDVSHEDPEVKFNWYVDGVEVHNAKTKPCEEQYGSTYRCVSVLTVLHQDWLNGKEYKCKVSNKALPA |

TABLE 30-continued

Seqence Listing

| SEQ ID NO: | Description | Source | Sequence |
|---|---|---|---|
| | | | PIEKTISKAKGQPREPQVYTLPPSREEMTKNQVSLTCLVKGFYPSDIAVEWESNGQPENNYKTTPPVLDSDGSFFLYSK LTVDKSRWQQGNVFSCSVMHEALHNHYTQKSLSLSPGK |
| 270. | MS_1_CCxCD3-scFc | Bi-specific HLE molecule | QVQLQESGPGLVKPSETLSLTCTVSGGSISSSSYYWGWIRQPPGKCLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG CGTKLTVLSGGGGSEVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGKGGGGSGGGGSGGGGSGGGGSGGGGSGGGGSDKTHTCPPCPAPELLGGPSVFLFPPKPKD TLMISRTPEVTCVVVDVSHEDPEVKFNWYVDGVEVHNAKTKPCEEQYGSTYRCVSVLTVLHQDWLNGKEYKCKVSNKAL PAPIEKTISKAKGQPREPQVYTLPPSREEMTKNQVSLTCLVKGFYPSDIAVEWESNGQPENNYKTTPPVLDSDGSFFLY SKLTVDKSRWQQGNVFSCSVMHEALHNHYTQKSLSLSPGK |
| 271. | MS_1_CCxCD3-scFc_delGK | Bi-specific HLE molecule | QVQLQESGPGLVKPSETLSLTCTVSGGSISSSSYYWGWIRQPPGKCLEWIGSIYYSGITNYNPSLKSRVTISVDTSKNQ FSLKLSSVTAADTAVYYCARPSNYDAFDIWGQGTMVTVSSGGGGSGGGGSGGGGSQSVLTQPPSVSGAPGQRVTISCTG SSSNIGAGYDVHWYQQVPGTAPKLLIYGNSKRPSGVPDRFSGSKSGTSASLAITGLQAEDEADYYCQSYDSSLGGWVFG CGTKLTVLSGGGGSEVQLVESGGGLVQPGGSLKLSCAASGFTFNKYAMNWVRQAPGKGLEWVARIRSKYNNYATYYADS VKDRFTISRDDSKNTAYLQMNNLKTEDTAVYYCVRHGNFGNSYISYWAYWGQGTLVTVSSGGGGSGGGGSGGGGSQTVV TQEPSLTVSPGGTVTLTCGSSTGAVTSGNYPNWVQQKPGQAPRGLIGGTKFLAPGTPARFSGSLLGGKAALTLSGVQPE DEAEYYCVLWYSNRWVFGGGTKLTVLGGGGDKTHTCPPCPAPELLGGPSVFLFPPKPKDTLMISRTPEVTCVVVDVSHE DPEVKFNWYVDGVEVHNAKTKPCEEQYGSTYRCVSVLTVLHQDWLNGKEYKCKVSNKALPAPIEKTISKAKGQPREPQV YTLPPSREEMTKNQVSLTCLVKGFYPSDIAVEWESNGQPENNYKTTPPVLDSDGSFFLYSKLTVDKSRWQQGNVFSCSV MHEALHNHYTQKSLSLSPGGGGSGGGGSGGGGSGGGGSGGGGSGGGGSDKTHTCPPCPAPELLGGPSVFLFPPKPKDTL MISRTPEVTCVVVDVSHEDPEVKFNWYVDGVEVHNAKTKPCEEQYGSTYRCVSVLTVLHQDWLNGKEYKCKVSNKALPA PIEKTISKAKGQPREPQVYTLPPSREEMTKNQVSLTCLVKGFYPSDIAVEWESNGQPENNYKTTPPVLDSDGSFFLYSK LTVDKSRWQQGNVFSCSVMHEALHNHYTQKSLSLSPGK |
| 272. | MS_2xCD3-scFc | Bi-specific HLE molecule | QVQLVESGGGVVQPGRSLRLSCAASGFTFSDHYMSWIRQTPGKGLEWVSYISSSGSTIYYADSVKGRFTISRDNAKNSL YLQMNSLRAEDTAVYYCARDLGPSFDYWGQGSLVTVSSGGGGSGGGGSGGGGSDIQMTQSPSSVSASVGDRVTITCRAS QGISSWLAWYQQKPGKAPKLLIDAASRLQSGVPSRFSGSGSGTDFTLTISSLQPEDFATYYCQQANSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 273. | MS_2xCD3-scFc_delGK | Bi-specific HLE molecule | QVQLVESGGGVVQPGRSLRLSCAASGFTFSDHYMSWIRQTPGKGLEWVSYISSSGSTIYYADSVKGRFTISRDNAKNSL YLQMNSLRAEDTAVYYCARDLGPSFDYWGQGSLVTVSSGGGGSGGGGSGGGGSDIQMTQSPSSVSASVGDRVTITCRAS QGISSWLAWYQQKPGKAPKLLIDAASRLQSGVPSRFSGSGSGTDFTLTISSLQPEDFATYYCQQANSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 274. | MS_2_CCxCD3-scFc | Bi-specific HLE molecule | QVQLVESGGGVVQPGRSLRLSCAASGFTFSDHYMSWIRQTPGKCLEWVSYISSSGSTIYYADSVKGRFTISRDNAKNSL YLQMNSLRAEDTAVYYCARDLGPSFDYWGQGSLVTVSSGGGGSGGGGSGGGGSDIQMTQSPSSVSASVGDRVTITCRAS QGISSWLAWYQQKPGKAPKLLIDAASRLQSGVPSRFSGSGSGTDFTLTISSLQPEDFATYYCQQANSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |

TABLE 30-continued

Sequence Listing

| SEQ ID NO: | Description | Source | Sequence |
|---|---|---|---|
| 275. | MS_2_CCxC D3-scFc_delGK | Bi-specific HLE molecule | QVQLVESGGGVVQPGRSLRLSCAASGFTFSDHYMSWIRQTPGKCLEWVSYISSSGSTIYYADSVKGRFTISRDNAKNSL YLQMNSLRAEDTAVYYCARDLGPSFDYWGQGSLVTVSSGGGGSGGGGSGGGGSDIQMTQSPSSVSASVGDRVTITCRAS QGISSWLAWYQQKPGKAPKLLIDAASRLQSGVPSRFSGSGSGTDFTLTISSLQPEDFATYYCQQANSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVTVQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 276. | MS_3xCD3-scFc | Bi-specific HLE molecule | QVQLVESGGGLVKPGGSLRLSCAASGFTFSDYYMTWIRQAPGKGLEWISYISSSGSTIYYADSVKGRFTISRDNAKNSL YLQMNSLRAEDTAVYYCARDRNSHFDYWGQGTLVTVSSGGGGSGGGGSGGGGSDIQMTQSPSSVSASVGDRVTITCRAS QGITRWLAWYQQKPGKAPKLLIYAASVLQSGVPSRFSGSGSGTDFTLTISSLQPEDFATYYCQQSNSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVTVQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 277. | MS_3xCD3-scFc_delGK | Bi-specific HLE molecule | QVQLVESGGGLVKPGGSLRLSCAASGFTFSDYYMTWIRQAPGKGLEWISYISSSGSTIYYADSVKGRFTISRDNAKNSL YLQMNSLRAEDTAVYYCARDRNSHFDYWGQGTLVTVSSGGGGSGGGGSGGGGSDIQMTQSPSSVSASVGDRVTITCRAS QGITRWLAWYQQKPGKAPKLLIYAASVLQSGVPSRFSGSGSGTDFTLTISSLQPEDFATYYCQQSNSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVTVQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 278. | MS_3_CCxCD3-scFc | Bi-specific HLE molecule | QVQLVESGGGLVKPGGSLRLSCAASGFTFSDYYMTWIRQAPGKCLEWISYISSSGSTIYYADSVKGRFTISRDNAKNSL YLQMNSLRAEDTAVYYCARDRNSHFDYWGQGTLVTVSSGGGGSGGGGSGGGGSDIQMTQSPSSVSASVGDRVTITCRAS QGITRWLAWYQQKPGKAPKLLIYAASVLQSGVPSRFSGSGSGTDFTLTISSLQPEDFATYYCQQSNSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVTVQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 279. | MS_3_CCxCD3-scFc_delGK | Bi-specific HLE molecule | QVQLVESGGGLVKPGGSLRLSCAASGFTFSDYYMTWIRQAPGKCLEWISYISSSGSTIYYADSVKGRFTISRDNAKNSL YLQMNSLRAEDTAVYYCARDRNSHFDYWGQGTLVTVSSGGGGSGGGGSGGGGSDIQMTQSPSSVSASVGDRVTITCRAS QGITRWLAWYQQKPGKAPKLLIYAASVLQSGVPSRFSGSGSGTDFTLTISSLQPEDFATYYCQQSNSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVTVQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 280. | MS_4xCD3-scFc | Bi-specific HLE mole | QVQLVESGGGLVKPGGSLRLSCAASGFTFSDYYMTWIRQAPGKGLEWLSYISSSGSTIYYADSVKGRFTISRDNAKNSL FLQMNSLRAEDTAVYYCARDRNSHFDYWGQGTLVTVSSGGGGSGGGGSGGGGSDIQMTQSPSSVSASVGDRVTITCRAS QGINTWLAWYQQKPGKAPKLLIYGASLQSGVPSRFSGSGSGTDFTLTISSLQPEDFATYYCQQAKSFPRTFGQGTKVE IKSGGGGSEVQLVESGGGLVQPGGSLKLSCAASGFTFNKYAMNWVRQAPGKGLEWVARIRSKYNNYATYYADSVKDRFT |

TABLE 30-continued

Sequence Listing

| SEQ ID NO: | Description | Source | Sequence |
|---|---|---|---|
| | | molecule | ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 281. | MS_4xCD3-scFc_delGK | Bi-specific HLE molecule | QVQLVESGGGLVKPGGSLRLSCAASGFTFSDYYMTWIRQAPGKGLEWLSYISSSGSTIYYADSVKGRFTISRDNAKNSL FLQMNSLRAEDTAVYYCARDRNSHFDYWGQGTLVTVSSGGGGSGGGGSGGGGSDIQMTQSPSSVSASVGDRVTITCRAS QGINTWLAWYQQKPGKAPKLLIYGASGLQSGVPSRFSGSGSGTDFTLTISSLQPEDFATYYCQQAKSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 282. | MS_4_CCxCD3-scFc | Bi-specific HLE molecule | QVQLVESGGGLVKPGGSLRLSCAASGFTFSDYYMTWIRQAPGKCLEWLSYISSSGSTIYYADSVKGRFTISRDNAKNSL FLQMNSLRAEDTAVYYCARDRNSHFDYWGQGTLVTVSSGGGGSGGGGSGGGGSDIQMTQSPSSVSASVGDRVTITCRAS QGINTWLAWYQQKPGKAPKLLIYGASGLQSGVPSRFSGSGSGTDFTLTISSLQPEDFATYYCQQAKSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 283. | MS_4_CCxCD3-scFc_delGK | Bi-specific HLE molecule | QVQLVESGGGLVKPGGSLRLSCAASGFTFSDYYMTWIRQAPGKCLEWLSYISSSGSTIYYADSVKGRFTISRDNAKNSL FLQMNSLRAEDTAVYYCARDRNSHFDYWGQGTLVTVSSGGGGSGGGGSGGGGSDIQMTQSPSSVSASVGDRVTITCRAS QGINTWLAWYQQKPGKAPKLLIYGASGLQSGVPSRFSGSGSGTDFTLTISSLQPEDFATYYCQQAKSFPRTFGCGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 284. | MS_5xCD3-scFc | Bi-specific HLE molecule | QVQLVESGGGLVKPGGSLRLSCAASGFTFSDHYMSWIRQAPGKGLEWFSYISSSGGIIYYADSVKGRFTISRDNAKNSL YLQMNSLRAEDTAVYYCARDVGSHFDYWGQGTLVTVSSGGGGSGGGGSGGGGSDIQMTQSPSSVSASVGDRVTITCRAS QDISRWLAWYQQKPGKAPKLLISAASRLQSGVPSRFSGSGSGTDFTLTISSLQPEDFAIYYCQQAKSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGKGGGGSGGGGSGGGGSGGGGSGGGGSGGGGSDKTHTCPPCPAPELLGGPSVFLFPPKPKDTLMISR TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 285. | MS_5xCD3-scFc_delGK | Bi-specific HLE molecule | QVQLVESGGGLVKPGGSLRLSCAASGFTFSDHYMSWIRQAPGKGLEWFSYISSSGGIIYYADSVKGRFTISRDNAKNSL YLQMNSLRAEDTAVYYCARDVGSHFDYWGQGTLVTVSSGGGGSGGGGSGGGGSDIQMTQSPSSVSASVGDRVTITCRAS QDISRWLAWYQQKPGKAPKLLISAASRLQSGVPSRFSGSGSGTDFTLTISSLQPEDFAIYYCQQAKSFPRTFGQGTKVE IKSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS |

TABLE 30-continued

Sequence Listing

| SEQ ID NO: | Description | Source | Sequence |
|---|---|---|---|
| | | | REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGGGGSGGGGSGGGGSGGGGSGGGGSGGGGSDKTHTCPPCPAPELLGGPSVFLFPPKPKDTLMISRTP<br>EVTCVVVDVSHEDPEVKFNWYVDGVEVHNAKTKPCEEQYGSTYRCVSVLTVLHQDWLNGKEYKCKVSNKALPAPIEKTI<br>SKAKGQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK |
| 286. | MS_5_CCxCD3-scFc | Bi-specific HLE molecule | QVQLVESGGGLVKPGGSLRLSCAASGFTFSDHYMSWIRQAPGKCLEWFSYISSSGGIIYYADSVKGRFTISRDNAKNSL<br>YLQMNSLRAEDTAVYYCARDVGSHFDYWGQGTLVTVSSGGGGSGGGGSGGGGSDIQMTQSPSSVSASVGDRVTITCRAS<br>QDISRWLAWYQQKPGKAPKLLISAASRLQSGVPSRFSGSGSGTDFTLTISSLQPEDFAIYYCQQAKSFPRTFGCGTKVE<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVLGGGGDKTHTCPPCPAPELLGGPSVFLFPPKPKDTLMISRTPEVTCVVVDVSHEDPEVKF<br>NWYVDGVEVHNAKTKPCEEQYGSTYRCVSVLTVLHQDWLNGKEYKCKVSNKALPAPIEKTISKAKGQPREPQVYTLPPS<br>REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGKGGGSGGGGSGGGGSGGGGSGGGGSGGGGSDKTHTCPPCPAPELLGGPSVFLFPPKPKDTLMISR<br>TPEVTCVVVDVSHEDPEVKFNWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGSFFLYSKLTVD<br>KSRWQQGNVFSCSVMHEALHNHYTQKSLSLSPGK |
| 287. | MS_5_CCxCD3-scFc_delGK | Bi-specific HLE molecule | QVQLVESGGGLVKPGGSLRLSCAASGFTFSDHYMSWIRQAPGKCLEWFSYISSSGGIIYYADSVKGRFTISRDNAKNSL<br>YLQMNSLRAEDTAVYYCARDVGSHFDYWGQGTLVTVSSGGGGSGGGGSGGGGSDIQMTQSPSSVSASVGDRVTITCRAS<br>QDISRWLAWYQQKPGKAPKLLISAASRLQSGVPSRFSGSGSGTDFTLTISSLQPEDFAIYYCQQAKSFPRTFGCGTKVE<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVLGGGGDKTHTCPPCPAPELLGGPSVFLFPPKPKDTLMISRTPEVTCVVVDVSHEDPEVKF<br>NWYVDGVEVHNAKTKPCEEQYGSTYRCVSVLTVLHQDWLNGKEYKCKVSNKALPAPIEKTISKAKGQPREPQVYTLPPS<br>REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGGGGSGGGGSGGGGSGGGGSGGGGSGGGGSDKTHTCPPCPAPELLGGPSVFLFPPKPKDTLMISRTP<br>EVTCVVVDVSHEDPEVKFNWYVDGVEVHNAKTKPCEEQYGSTYRCVSVLTVLHQDWLNGKEYKCKVSNKALPAPIEKTI<br>SKAKGQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK |
| 288. | MS_6xCD3-scFc | Bi-specific HLE molecule | QVQLVESGGGLVKPGGSLRLSCAASGFTFSDHYMSWIRQAPGKGLEWISYISNSGSIIYYVDSVKGRFTISRDNAKNSL<br>YLQMNSLRAEDTAVYYCARDVRTAFDYWGQGTLVTVSSGGGGSGGGGSGGGGSDIQMTQSPSSVSASVGDRVTITCRAS<br>QSIGSWLAWYQQKPGKAPNLLIYAASSLQSGVPSRFSGSGSGTDFTLTISSLQPEDFATYYCQQANSFPRTFGQGTKVD<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVLGGGGDKTHTCPPCPAPELLGGPSVFLFPPKPKDTLMISRTPEVTCVVVDVSHEDPEVKF<br>NWYVDGVEVHNAKTKPCEEQYGSTYRCVSVLTVLHQDWLNGKEYKCKVSNKALPAPIEKTISKAKGQPREPQVYTLPPS<br>REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGKGGGSGGGGSGGGGSGGGGSGGGGSGGGGSDKTHTCPPCPAPELLGGPSVFLFPPKPKDTLMISR<br>TPEVTCVVVDVSHEDPEVKFNWYVDGVEVHNAKTKPCEEQYGSTYRCVSVLTVLHQDWLNGKEYKCKVSNKALPAPIEK<br>TISKAKGQPREPQVYTLPPSREEMTKNQVSLTCLVKGFYPSDIAVEWESNGQPENNYKTTPPVLDSDGSFFLYSKLTVD<br>KSRWQQGNVFSCSVMHEALHNHYTQKSLSLSPGK |
| 289. | MS_6xCD3-scFc_delGK | Bi-specific HLE molecule | QVQLVESGGGLVKPGGSLRLSCAASGFTFSDHYMSWIRQAPGKGLEWISYISNSGSIIYYVDSVKGRFTISRDNAKNSL<br>YLQMNSLRAEDTAVYYCARDVRTAFDYWGQGTLVTVSSGGGGSGGGGSGGGGSDIQMTQSPSSVSASVGDRVTITCRAS<br>QSIGSWLAWYQQKPGKAPNLLIYAASSLQSGVPSRFSGSGSGTDFTLTISSLQPEDFATYYCQQANSFPRTFGQGTKVD<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVLGGGGDKTHTCPPCPAPELLGGPSVFLFPPKPKDTLMISRTPEVTCVVVDVSHEDPEVKF<br>NWYVDGVEVHNAKTKPCEEQYGSTYRCVSVLTVLHQDWLNGKEYKCKVSNKALPAPIEKTISKAKGQPREPQVYTLPPS<br>REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGGGGSGGGGSGGGGSGGGGSGGGGSGGGGSDKTHTCPPCPAPELLGGPSVFLFPPKPKDTLMISRTP<br>EVTCVVVDVSHEDPEVKFNWYVDGVEVHNAKTKPCEEQYGSTYRCVSVLTVLHQDWLNGKEYKCKVSNKALPAPIEKTI<br>SKAKGQPREPQVYTLPPSREEMTKNQVSLTCLVKGFYPSDIAVEWESNGQPENNYKTTPPVLDSDGSFFLYSKLTVDKS<br>RWQQGNVFSCSVMHEALHNHYTQKSLSLSPGK |
| 290. | MS_6_CCxCD3-scFc | Bi-specific HLE molecule | QVQLVESGGGLVKPGGSLRLSCAASGFTFSDHYMSWIRQAPGKCLEWISYISNSGSIIYYVDSVKGRFTISRDNAKNSL<br>YLQMNSLRAEDTAVYYCARDVRTAFDYWGQGTLVTVSSGGGGSGGGGSGGGGSDIQMTQSPSSVSASVGDRVTITCRAS<br>QSIGSWLAWYQQKPGKAPNLLIYAASSLQSGVPSRFSGSGSGTDFTLTISSLQPEDFATYYCQQANSFPRTFGCGTKVD<br>IKSGGGGSEVQLVESGGGLVQPGGSLKLSCAASGFTFNKYAMNWVRQAPGKGLEWVARIRSKYNNYATYYADSVKDRFT<br>ISRDDSKNTAYLQMNNLKTEDTAVYYCVRHGNFGNSYISYWAYWGQGTLVTVSSGGGGSGGGGSGGGGSQTVVTQEPSL<br>TVSPGGTVTLTCGSSTGAVTSGNYPNWVQQKPGQAPRGLIGGTKFLAPGTPARFSGSLLGGKAALTLSGVQPEDEAEYY<br>CVLWYSNRWVFGGGTKLTVLGGGGDKTHTCPPCPAPELLGGPSVFLFPPKPKDTLMISRTPEVTCVVVDVSHEDPEVKF<br>NWYVDGVEVHNAKTKPCEEQYGSTYRCVSVLTVLHQDWLNGKEYKCKVSNKALPAPIEKTISKAKGQPREPQVYTLPPS<br>REEMTKNQVSLTCLVKGFYPSDIAVEWESNGQPENNYKTTPPVLDSDGSFFLYSKLTVDKSRWQQGNVFSCSVMHEALH<br>NHYTQKSLSLSPGKGGGSGGGGSGGGGSGGGGSGGGGSGGGGSDKTHTCPPCPAPELLGGPSVFLFPPKPKDTLMISR |

TABLE 30-continued

Sequence Listing

| SEQ ID NO: | Description | Source | Sequence |
|---|---|---|---|
| | | | TPEVTCVVVDVSHEDPEVKFNWYVDGVEVHNAKTKPCEEQYGSTYRCVSVLTVLHQDWLNGKEYKCKVSNKALPAPIEK TISKAKGQPREPQVYTLPPSREEMTKNQVSLTCLVKGFYPSDIAVEWESNGQPENNYKTTPPVLDSDGSFFLYSKLTVD KSRWQQGNVFSCSVMHEALHNHYTQKSLSLSPGK |
| 291. | MS_6_CCxCD3-sc_Fc_delGK | Bi-specific HLE molecule | QVQLVESGGGLVKPGGSLRLSCAASGFTFSDHYMSWIRQAPGKCLEWISYISNSGSIIYYVDSVKGRFTISRDNAKNSL YLQMNSLRAEDTAVYYCARDVRTAFDYWGQGTLVTVSSGGGGSGGGGSGGGGSDIQMTQSPSSVSASVGDRVTITCRAS QSIGSWLAWYQQKPGKAPNLLIYAASSLQSGVPSRFSGSGSGTDFTLTISSLQPEDFATYYCQQANSFPRTFGCGTKVD IKSGGGGSEVQLVESGGGLVQPGGSLKLSCAASGFTFNKYAMNWVRQAPGKGLEWVARIRSKYNNYATYYADSVKDRFT ISRDDDSKNTAYLQMNNLKTEDTAVYYCVRHGNFGNSYISYWAYWGQGTLVTVSSGGGGSGGGGSGGGGSQTVVTQEPSL TVSPGGTVTLTCGSSTGAVTSGNYPNWVQQKPGQAPRGLIGGTKFLAPGTPARFSGSLLGGKAALTLSGVQPEDEAEYY CVLWYSNRWVFGGGTKLTVLGGGGDKTHTCPPCPAPELLGGPSVFLFPPKPKDTLMISRTPEVTCVVVDVSHEDPEVKF NWYVDGVEVHNAKTKPCEEQYGSTYRCVSVLTVLHQDWLNGKEYKCKVSNKALPAPIEKTISKAKGQPREPQVYTLPPS REEMTKNQVSLTCLVKGFYPSDIAVEWESNGQPENNYKTTPPVLDSDGSFFLYSKLTVDKSRWQQGNVFSCSVMHEALH NHYTQKSLSLSPGGGGSGGGGSGGGGSGGGGSGGGGSGGGGSDKTHTCPPCPAPELLGGPSVFLFPPKPKDTLMISRTP EVTCVVVDVSHEDPEVKFNWYVDGVEVHNAKTKPCEEQYGSTYRCVSVLTVLHQDWLNGKEYKCKVSNKALPAPIEKTI SKAKGQPREPQVYTLPPSREEMTKNQVSLTCLVKGFYPSDIAVEWESNGQPENNYKTTPPVLDSDGSFFLYSKLTVDKS RWQQGNVFSCSVMHEALHNHYTQKSLSLSPGK |
| 292. | MS_7xCD3-scFc | Bi-specific HLE molecule | EVQLVESGGGLIQPGGSLRLSCAVSGFTVSSKFMTWVRQAPGKGLEWVSVIYSGGKTYYADSVKGRFTISRDNSKNTLY LQMNSLRAEDTAVYYCARDSGGWGYFDYWGQGTLVTVSSGGGGSGGGGSGGGGSDIVMTQSPDSLAVSLGERATINCKS SQSVLYSSNNKNYLAWYQQKPGQPPKLLIYWASTRESGVPDRFSGSGSGTDFTLTISSLQAEDVAVYYCQQYYSTPPTF GQGTKVEIKSGGGGSEVQLVESGGGLVQPGGSLKLSCAASGFTFNKYAMNWVRQAPGKGLEWVARIRSKYNNYATYYAD SVKDRFTISRDDSKNTAYLQMNNLKTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGTPARFSGSLLGGKAALTLSGVQP EDEAEYYCVLWYSNRWVFGGGTKLTVLGGGGDKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNGKEYKCKVSNKALPAPIEKTISKAKGQPREPQ VYTLPPSREEMTKNQVSLTCLVKGFYPSDIAVEWESNGQPENNYKTTPPVLDSDGSFFLYSKLTVDKSRWQQGNVFSCS VMHEALHNHYTQKSLSLSPGKGGGGSGGGGSGGGGSGGGGSGGGGSGGGGSDKTHTCPPCPAPELLGGPSVFLFPPKPK DTLMISRTPEVTCVVVDVSHEDPEVKFNWYVDGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |
| 293. | MS_7xCD3-scFc_delGK | Bi-specific HLE molecule | EVQLVESGGGLIQPGGSLRLSCAVSGFTVSSKFMTWVRQAPGKGLEWVSVIYSGGKTYYADSVKGRFTISRDNSKNTLY LQMNSLRAEDTAVYYCARDSGGWGYFDYWGQGTLVTVSSGGGGSGGGGSGGGGSDIVMTQSPDSLAVSLGERATINCKS SQSVLYSSNNKNYLAWYQQKPGQPPKLLIYWASTRESGVPDRFSGSGSGTDFTLTISSLQAEDVAVYYCQQYYSTPPTF GQGTKVEIKSGGGGSEVQLVESGGGLVQPGGSLKLSCAASGFTFNKYAMNWVRQAPGKGLEWVARIRSKYNNYATYYAD SVKDRFTISRDDSKNTAYLQMNNLKTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGTPARFSGSLLGGKAALTLSGVQP EDEAEYYCVLWYSNRWVFGGGTKLTVLGGGGDKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNGKEYKCKVSNKALPAPIEKTISKAKGQPREPQ VYTLPPSREEMTKNQVSLTCLVKGFYPSDIAVEWESNGQPENNYKTTPPVLDSDGSFFLYSKLTVDKSRWQQGNVFSCS VMHEALHNHYTQKSLSLSPGGGGSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQPENNYKTTPPVLDSDGSFFLYS KLTVDKSRWQQGNVFSCSVMHEALHNHYTQKSLSLSPGK |
| 294. | MS_7_CCxCD3-scFc | Bi-specific HLE molecule | EVQLVESGGGLIQPGGSLRLSCAVSGFTVSSKFMTWVRQAPGKCLEWVSVIYSGGKTYYADSVKGRFTISRDNSKNTLY LQMNSLRAEDTAVYYCARDSGGWGYFDYWGQGTLVTVSSGGGGSGGGGSGGGGSDIVMTQSPDSLAVSLGERATINCKS SQSVLYSSNNKNYLAWYQQKPGQPPKLLIYWASTRESGVPDRFSGSGSGTDFTLTISSLQAEDVAVYYCQQYYSTPPTF GCGTKVEIKSGGGGSEVQLVESGGGLVQPGGSLKLSCAASGFTFNKYAMNWVRQAPGKGLEWVARIRSKYNNYATYYAD SVKDRFTISRDDSKNTAYLQMNNLKTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGTPARFSGSLLGGKAALTLSGVQP EDEAEYYCVLWYSNRWVFGGGTKLTVLGGGGDKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNGKEYKCKVSNKALPAPIEKTISKAKGQPREPQ VYTLPPSREEMTKNQVSLTCLVKGFYPSDIAVEWESNGQPENNYKTTPPVLDSDGSFFLYSKLTVDKSRWQQGNVFSCS VMHEALHNHYTQKSLSLSPGKGGGGSGGGGSGGGGSGGGGSGGGGSGGGGSDKTHTCPPCPAPELLGGPSVFLFPPKPK DTLMISRTPEVTCVVVDVSHEDPEVKFNWYVDGVEVHNAKTKPCEEQYGSTYRCVSVLTVLHQDWLNGKEYKCKVSNKA LPAPIEKTISKAKGQPREPQVYTLPPSREEMTKNQVSLTCLVKGFYPSDIAVEWESNGQPENNYKTTPPVLDSDGSFFL YSKLTVDKSRWQQGNVFSCSVMHEALHNHYTQKSLSLSPGK |
| 295. | MS_7_CCxCD3-scFc_delGK | Bi-specific HLE molecule | EVQLVESGGGLIQPGGSLRLSCAVSGFTVSSKFMTWVRQAPGKCLEWVSVIYSGGKTYYADSVKGRFTISRDNSKNTLY LQMNSLRAEDTAVYYCARDSGGWGYFDYWGQGTLVTVSSGGGGSGGGGSGGGGSDIVMTQSPDSLAVSLGERATINCKS SQSVLYSSNNKNYLAWYQQKPGQPPKLLIYWASTRESGVPDRFSGSGSGTDFTLTISSLQAEDVAVYYCQQYYSTPPTF GCGTKVEIKSGGGGSEVQLVESGGGLVQPGGSLKLSCAASGFTFNKYAMNWVRQAPGKGLEWVARIRSKYNNYATYYAD SVKDRFTISRDDSKNTAYLQMNNLKTEDTAVYYCVRHGNFGNSYISYWAYWGQGTLVTVSSGGGGSGGGGSGGGGSQTV VTQEPSLTVSPGGTVTLTCGSSTGAVTSGNYPNWVQQKPGQAPRGLIGGTKFLAPGTPARFSGSLLGGKAALTLSGVQP EDEAEYYCVLWYSNRWVFGGGTKLTVLGGGGDKTHTCPPCPAPELLGGPSVFLFPPKPKDTLMISRTPEVTCVVVDVSH EDPEVKFNWYVDGVEVHNAKTKPCEEQYGSTYRCVSVLTVLHQDWLNGKEYKCKVSNKALPAPIEKTISKAKGQPREPQ VYTLPPSREEMTKNQVSLTCLVKGFYPSDIAVEWESNGQPENNYKTTPPVLDSDGSFFLYSKLTVDKSRWQQGNVFSCS VMHEALHNHYTQKSLSLSPGGGGSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQPENNYKTTPPVLDSDGSFFLYS KLTVDKSRWQQGNVFSCSVMHEALHNHYTQKSLSLSPGK |

TABLE 30-continued

Sequence Listing

| SEQ ID NO: | Description | Source | Sequence |
|---|---|---|---|
| 296. | MS_8xCD3-scFc | Bispecific HLE molecule | QVQLQESGPGLVKPSETLSLTCTVSGGSISSYYWNWIRQPPGKGLEWIGRIYYNGNTYYNPSLKSRVTISGDTSKNQFS LKLSSVTAADTAVYYCARPKLGIDAFDIWGQGTMVTVSSGGGGSGGGGSGGGGSQSVLTQPPSVSGAPGQRVTISCTGS SSNIGAGYDVHWYQQLPGTAPKLLIYGNSNRPSGVPDRFSGSKSGTSASLAITGLQAEDEADYYCQSYDSSLSGWVFGG GTKLTVLSGGGGSEVQLVESGGGLVQPGGSLKLSCAASGFTFNKYAMNWVRQAPGKGLEWVARIRSKYNNYATYYADSV KDRFTISRDDSKNTAYLQMNNLKTEDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPARFSGSLLGGKAALTLSGVQPED EAEYYCVLWYSNRWVFGGGTKLTVLGGGGDKTHTCPPCPAPELLGGPSVFLFPPKPKDTLMISRTPEVTCVVVDVSHED PEVKFNWYVDGVEVHNAKTKPCEEQYGSTYRCVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVM HEALHNHYTQKSLSLSPGKGGGGSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQPENNYKTTPPVLDSDGSFFLYS KLTVDKSRWQQGNVFSCSVMHEALHNHYTQKSLSLSPGK |
| 297. | MS_8xCD3-scFc_delGK | Bispecific HLE molecule | QVQLQESGPGLVKPSETLSLTCTVSGGSISSYYWNWIRQPPGKGLEWIGRIYYNGNTYYNPSLKSRVTISGDTSKNQFS LKLSSVTAADTAVYYCARPKLGIDAFDIWGQGTMVTVSSGGGGSGGGGSGGGGSQSVLTQPPSVSGAPGQRVTISCTGS SSNIGAGYDVHWYQQLPGTAPKLLIYGNSNRPSGVPDRFSGSKSGTSASLAITGLQAEDEADYYCQSYDSSLSGWVFGG GTKLTVLSGGGGSEVQLVESGGGLVQPGGSLKLSCAASGFTFNKYAMNWVRQAPGKGLEWVARIRSKYNNYATYYADSV KDRFTISRDDSKNTAYLQMNNLKTEDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPARFSGSLLGGKAALTLSGVQPED EAEYYCVLWYSNRWVFGGGTKLTVLGGGGDKTHTCPPCPAPELLGGPSVFLFPPKPKDTLMISRTPEVTCVVVDVSHED PEVKFNWYVDGVEVHNAKTKPCEEQYGSTYRCVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVM HEALHNHYTQKSLSLSPGGGGSGGGGSGGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| 298. | MS_8_CCxCD3-scFc | Bispecific HLE molecule | QVQLQESGPGLVKPSETLSLTCTVSGGSISSYYWNWIRQPPGKCLEWIGRIYYNGNTYYNPSLKSRVTISGDTSKNQFS LKLSSVTAADTAVYYCARPKLGIDAFDIWGQGTMVTVSSGGGGSGGGGSGGGGSQSVLTQPPSVSGAPGQRVTISCTGS SSNIGAGYDVHWYQQLPGTAPKLLIYGNSNRPSGVPDRFSGSKSGTSASLAITGLQAEDEADYYCQSYDSSLSGWVFGC GTKLTVLSGGGGSEVQLVESGGGLVQPGGSLKLSCAASGFTFNKYAMNWVRQAPGKGLEWVARIRSKYNNYATYYADSV KDRFTISRDDSKNTAYLQMNNLKTEDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPARFSGSLLGGKAALTLSGVQPED EAEYYCVLWYSNRWVFGGGTKLTVLGGGGDKTHTCPPCPAPELLGGPSVFLFPPKPKDTLMISRTPEVTCVVVDVSHED PEVKFNWYVDGVEVHNAKTKPCEEQYGSTYRCVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVM HEALHNHYTQKSLSLSPGKGGGGSGGGGSGGGGSGGGGSGGGGSGGGGSDKTHTCPPCPAPELLGGPSVFLFPPKPKDT LMISRTPEVTCVVVDVSHEDPEVKFNWYVDGVEVHNAKTKPCEEQYGSTYRCVSVLTVLHQDWLNGKEYKCKVSNKALP APIEKTISKAKGQPREPQVYTLPPSREEMTKNQVSLTCLVKGFYPSDIAVEWESNGQPENNYKTTPPVLDSDGSFFLYS KLTVDKSRWQQGNVFSCSVMHEALHNHYTQKSLSLSPGK |
| 299. | MS_8_CCxCD3-scFc_delGK | Bispecific HLE molecule | QVQLQESGPGLVKPSETLSLTCTVSGGSISSYYWNWIRQPPGKCLEWIGRIYYNGNTYYNPSLKSRVTISGDTSKNQFS LKLSSVTAADTAVYYCARPKLGIDAFDIWGQGTMVTVSSGGGGSGGGGSGGGGSQSVLTQPPSVSGAPGQRVTISCTGS SSNIGAGYDVHWYQQLPGTAPKLLIYGNSNRPSGVPDRFSGSKSGTSASLAITGLQAEDEADYYCQSYDSSLSGWVFGC GTKLTVLSGGGGSEVQLVESGGGLVQPGGSLKLSCAASGFTFNKYAMNWVRQAPGKGLEWVARIRSKYNNYATYYADSV KDRFTISRDDSKNTAYLQMNNLKTEDTAVYYCVRHGNFGNSYISYWAYWGQGTLVTVSSGGGGSGGGGSGGGGSQTVVT QEPSLTVSPGGTVTLTCGSSTGAVTSGNYPNWVQQKPGQAPRGLIGGTKFLAPGTPARFSGSLLGGKAALTLSGVQPED EAEYYCVLWYSNRWVFGGGTKLTVLGGGGDKTHTCPPCPAPELLGGPSVFLFPPKPKDTLMISRTPEVTCVVVDVSHED PEVKFNWYVDGVEVHNAKTKPCEEQYGSTYRCVSVLTVLHQDWLNGKEYKCKVSNKALPAPIEKTISKAKGQPREPQVY TLPPSREEMTKNQVSLTCLVKGFYPSDIAVEWESNGQPENNYKTTPPVLDSDGSFFLYSKLTVDKSRWQQGNVFSCSVM HEALHNHYTQKSLSLSPGGGGSGGGGSGGGGSGGGGSGGGGSGGGGSDKTHTCPPCPAPELLGGPSVFLFPPKPKDTLM ISRTPEVTCVVVDVSHEDPEVKFNWYVDGVEVHNAKTKPCEEQYGSTYRCVSVLTVLHQDWLNGKEYKCKVSNKALPAP IEKTISKAKGQPREPQVYTLPPSREEMTKNQVSLTCLVKGFYPSDIAVEWESNGQPENNYKTTPPVLDSDGSFFLYSKL TVDKSRWQQGNVFSCSVMHEALHNHYTQKSLSLSPGK |
| 300. | Peptide linker | $(G_4S)_4$ linker | GGGGSGGGGSGGGGSGGGGS |
| 301. | Peptide linker | $(G_4S)_5$ linker | GGGGSGGGGSGGGGSGGGGSGGGGS |
| 302. | Peptide linker | $(G_4S)_6$ linker | GGGGSGGGGSGGGGSGGGGSGGGGSGGGGS |
| 303. | Peptide linker | $(G_4S)_7$ linker | GGGGSGGGGSGGGGSGGGGSGGGGSGGGGSGGGGS |
| 304. | Peptide linker | $(G_4S)_8$ linker | GGGGSGGGGSGGGGSGGGGSGGGGSGGGGSGGGGSGGGGS |

SEQUENCE LISTING (327 sequences)

SEQ ID NO: 1 - protein, 4 aa, Artificial Sequence
  Synthetic peptide
GGGG

SEQ ID NO: 2 - protein, 5 aa, Artificial Sequence
  Synthetic peptide
GGGGS

SEQ ID NO: 3 - protein, 5 aa, Artificial Sequence
  Synthetic peptide
GGGGQ

SEQ ID NO: 4 - protein, 6 aa, Artificial Sequence
  Synthetic peptide
PGGGGS

SEQ ID NO: 5 - protein, 6 aa, Artificial Sequence
  Synthetic peptide
PGGDGS

SEQ ID NO: 6 - protein, 6 aa, Artificial Sequence
  Synthetic peptide
SGGGGS

SEQ ID NO: 7 - protein, 9 aa, Artificial Sequence
  Synthetic peptide
GGGGSGGGS

SEQ ID NO: 8 - protein, 10 aa, Artificial Sequence
  Synthetic peptide
GGGGSGGGGS

SEQ ID NO: 9 - protein, 15 aa, Artificial Sequence
  Synthetic peptide
GGGGSGGGGSGGGGS

SEQ ID NO: 10 - protein, 6 aa, Artificial Sequence
  Synthetic peptide
HHHHHH

SEQ ID NO: 11 - protein, 14 aa, Artificial Sequence
  Synthetic peptide
GSSTGAVTSGYYPN

SEQ ID NO: 12 - protein, 7 aa, Artificial Sequence
  Synthetic peptide
GTKFLAP

SEQ ID NO: 13 - protein, 9 aa, Artificial Sequence
  Synthetic peptide
ALWYSNRWV

SEQ ID NO: 14 - protein, 5 aa, Artificial Sequence
  Synthetic peptide
IYAMN

SEQ ID NO: 15 - protein, 19 aa, Artificial Sequence
  Synthetic peptide
RIRSKYNNYATYYADSVKS

SEQ ID NO: 16 - protein, 14 aa, Artificial Sequence
  Synthetic peptide
HGNFGNSYVSFFAY

SEQ ID NO: 17 - protein, 125 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 18 - protein, 109 aa, Artificial Sequence
  Synthetic peptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 19 - protein, 249 aa, Artificial Sequence
  Synthetic peptide
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 20 - protein, 14 aa, Artificial Sequence
  Synthetic peptide
GSSTGAVTSGYYPN

SEQ ID NO: 21 - protein, 7 aa, Artificial Sequence
  Synthetic peptide
GTKFLAP

SEQ ID NO: 22 - protein, 9 aa, Artificial Sequence
  Synthetic peptide
ALWYSNRWV

SEQ ID NO: 23 - protein, 5 aa, Artificial Sequence
  Synthetic peptide
KYAMN

SEQ ID NO: 24 - protein, 19 aa, Artificial Sequence
  Synthetic peptide
RIRSKYNNYATYYADSVKD

SEQ ID NO: 25 - protein, 14 aa, Artificial Sequence
  Synthetic peptide
HGNFGNSYISYWAY

SEQ ID NO: 26 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 27 - protein, 109 aa, Artificial Sequence; identical to SEQ ID NO: 18
  Synthetic peptide

SEQ ID NO: 28 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 29 - protein, 14 aa, Artificial Sequence
  Synthetic peptide
GSSTGAVTSGYYPN

SEQ ID NO: 30 - protein, 7 aa, Artificial Sequence
  Synthetic peptide
GTKFLAP

SEQ ID NO: 31 - protein, 9 aa, Artificial Sequence
  Synthetic peptide
ALWYSNRWV

SEQ ID NO: 32 - protein, 5 aa, Artificial Sequence
  Synthetic peptide
SYAMN

SEQ ID NO: 33 - protein, 19 aa, Artificial Sequence
  Synthetic peptide
RIRSKYNNYATYYADSVKG

SEQ ID NO: 34 - protein, 14 aa, Artificial Sequence
  Synthetic peptide
HGNFGNSYLSFWAY

SEQ ID NO: 35 - protein, 125 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 36 - protein, 109 aa, Artificial Sequence; identical to SEQ ID NO: 18
  Synthetic peptide

SEQ ID NO: 37 - protein, 249 aa, Artificial Sequence
  Synthetic peptide
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 38 - protein, 14 aa, Artificial Sequence
  Synthetic peptide
GSSTGAVTSGYYPN

SEQ ID NO: 39 - protein, 7 aa, Artificial Sequence
  Synthetic peptide
GTKFLAP

SEQ ID NO: 40 - protein, 9 aa, Artificial Sequence
  Synthetic peptide
ALWYSNRWV

SEQ ID NO: 41 - protein, 5 aa, Artificial Sequence
  Synthetic peptide
RYAMN

SEQ ID NO: 42 - protein, 19 aa, Artificial Sequence
  Synthetic peptide
RIRSKYNNYATYYADSVKG

SEQ ID NO: 43 - protein, 14 aa, Artificial Sequence
  Synthetic peptide
HGNFGNSYLSYFAY

SEQ ID NO: 44 - protein, 125 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 45 - protein, 109 aa, Artificial Sequence; identical to SEQ ID NO: 18
  Synthetic peptide

SEQ ID NO: 46 - protein, 249 aa, Artificial Sequence
  Synthetic peptide
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 47 - protein, 14 aa, Artificial Sequence
  Synthetic peptide
RSSTGAVTSGYYPN

SEQ ID NO: 48 - protein, 7 aa, Artificial Sequence
  Synthetic peptide
ATDMRPS

SEQ ID NO: 49 - protein, 9 aa, Artificial Sequence
  Synthetic peptide
ALWYSNRWV

SEQ ID NO: 50 - protein, 5 aa, Artificial Sequence
  Synthetic peptide
VYAMN

SEQ ID NO: 51 - protein, 19 aa, Artificial Sequence
  Synthetic peptide
RIRSKYNNYATYYADSVKK

SEQ ID NO: 52 - protein, 14 aa, Artificial Sequence
  Synthetic peptide
HGNFGNSYLSWWAY

SEQ ID NO: 53 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 54 - protein, 109 aa, Artificial Sequence
  Synthetic peptide
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 55 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 56 - protein, 14 aa, Artificial Sequence
  Synthetic peptide
GSSTGAVTSGYYPN

SEQ ID NO: 57 - protein, 7 aa, Artificial Sequence
  Synthetic peptide
GTKFLAP

SEQ ID NO: 58 - protein, 9 aa, Artificial Sequence
  Synthetic peptide
ALWYSNRWV

SEQ ID NO: 59 - protein, 5 aa, Artificial Sequence
  Synthetic peptide
KYAMN

SEQ ID NO: 60 - protein, 19 aa, Artificial Sequence
  Synthetic peptide
RIRSKYNNYATYYADSVKS

SEQ ID NO: 61 - protein, 14 aa, Artificial Sequence
  Synthetic peptide
HGNFGNSYTSYYAY

SEQ ID NO: 62 - protein, 125 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 63 - protein, 109 aa, Artificial Sequence; identical to SEQ ID NO: 18
  Synthetic peptide

SEQ ID NO: 64 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 65 - protein, 14 aa, Artificial Sequence
  Synthetic peptide
RSSTGAVTSGYYPN

SEQ ID NO: 66 - protein, 7 aa, Artificial Sequence
  Synthetic peptide
ATDMRPS

SEQ ID NO: 67 - protein, 9 aa, Artificial Sequence
  Synthetic peptide
ALWYSNRWV

SEQ ID NO: 68 - protein, 5 aa, Artificial Sequence
  Synthetic peptide
GYAMN

SEQ ID NO: 69 - protein, 19 aa, Artificial Sequence
  Synthetic peptide
RIRSKYNNYATYYADSVKE

SEQ ID NO: 70 - protein, 14 aa, Artificial Sequence
  Synthetic peptide
HRNFGNSYLSWFAY

SEQ ID NO: 71 - protein, 125 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 72 - protein, 109 aa, Artificial Sequence; identical to SEQ ID NO: 54
  Synthetic peptide

SEQ ID NO: 73 - protein, 249 aa, Artificial Sequence
  Synthetic peptide
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 74 - protein, 14 aa, Artificial Sequence
  Synthetic peptide
GSSTGAVTSGYYPN

SEQ ID NO: 75 - protein, 7 aa, Artificial Sequence
  Synthetic peptide
GTKFLAP

SEQ ID NO: 76 - protein, 9 aa, Artificial Sequence
  Synthetic peptide
ALWYSNRWV

SEQ ID NO: 77 - protein, 5 aa, Artificial Sequence
  Synthetic peptide
VYAMN

SEQ ID NO: 78 - protein, 19 aa, Artificial Sequence
  Synthetic peptide
RIRSKYNNYATYYADSVKK

SEQ ID NO: 79 - protein, 14 aa, Artificial Sequence
  Synthetic peptide
HGNFGNSYISWWAY

SEQ ID NO: 80 - protein, 125 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 81 - protein, 109 aa, Artificial Sequence; identical to SEQ ID NO: 18
  Synthetic peptide

SEQ ID NO: 82 - protein, 249 aa, Artificial Sequence
  Synthetic peptide
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 83 - protein, 14 aa, Artificial Sequence
  Synthetic peptide
GSSTGAVTSGNYPN

SEQ ID NO: 84 - protein, 7 aa, Artificial Sequence
  Synthetic peptide
GTKFLAP

SEQ ID NO: 85 - protein, 9 aa, Artificial Sequence
  Synthetic peptide
VLWYSNRWV

SEQ ID NO: 86 - protein, 5 aa, Artificial Sequence
  Synthetic peptide
SYAMN

SEQ ID NO: 87 - protein, 19 aa, Artificial Sequence
  Synthetic peptide
RIRSKYNNYATYYADSVKG

SEQ ID NO: 88 - protein, 14 aa, Artificial Sequence
  Synthetic peptide
HGNFGNSYVSWWAY

SEQ ID NO: 89 - protein, 125 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 90 - protein, 109 aa, Artificial Sequence
  Synthetic peptide
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 91 - protein, 249 aa, Artificial Sequence
  Synthetic peptide
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 92 - protein, 14 aa, Artificial Sequence
  Synthetic peptide
GSSTGAVTSGNYPN

SEQ ID NO: 93 - protein, 7 aa, Artificial Sequence
  Synthetic peptide
GTKFLAP

SEQ ID NO: 94 - protein, 9 aa, Artificial Sequence
  Synthetic peptide
VLWYSNRWV

SEQ ID NO: 95 - protein, 5 aa, Artificial Sequence
  Synthetic peptide
KYAMN

SEQ ID NO: 96 - protein, 19 aa, Artificial Sequence
  Synthetic peptide
RIRSKYNNYATYYADSVKD

SEQ ID NO: 97 - protein, 14 aa, Artificial Sequence
  Synthetic peptide
HGNFGNSYISYWAY

SEQ ID NO: 98 - protein, 125 aa, Artificial Sequence; identical to SEQ ID NO: 26
  Synthetic peptide

SEQ ID NO: 99 - protein, 109 aa, Artificial Sequence; identical to SEQ ID NO: 90
  Synthetic peptide

SEQ ID NO: 100 - protein, 249 aa, Artificial Sequence
  Synthetic peptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 101 - protein, 125 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 102 - protein, 109 aa, Artificial Sequence; identical to SEQ ID NO: 90
  Synthetic peptide

SEQ ID NO: 103 - protein, 249 aa, Artificial Sequence
  Synthetic peptide
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 104 - protein, 585 aa, Homo sapiens [sequence omitted]

SEQ ID NO: 105 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 106 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 107 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 108 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 109 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 110 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 111 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 112 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 113 - protein, 585 aa, Artificial Sequence
  Synthetic peptide
DAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 114 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 115 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 116 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 117 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 118 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 119 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 120 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 121 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 122 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 123 - protein, 585 aa, Artificial Sequence
  Synthetic peptide
DAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 124 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 125 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAGTFTFHADICTLSEKERQIKKQTALVELVKHKPKATKEQLKAAMDDFAAFVEKCCKADDKETCFAEEGKKLVAASQAALGL

SEQ ID NO: 126 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPKLVAASQAALGL

SEQ ID NO: 127 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 128 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALGVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 129 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDKFAAFVEKCCKADDKETCFAEEGPKLVAASQAALGL

SEQ ID NO: 130 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPHLVAASQAALGL

SEQ ID NO: 131 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGPHLVAASKAALGL

SEQ ID NO: 132 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDKFAAFVEKCCKADDKETCFAEEGPKLVAASKAALGL

SEQ ID NO: 133 - protein, 585 aa, Artificial Sequence
  Synthetic peptide
DAHKSEVAHRFKDLGEENFKALVLIAFAQYLQQAPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALDVDETYVPKEFNAETFTFHADICTLSEKERQIKKQTALVELVKHKPKATKEQLKAVMDDFAAFVEKCCKADDKETCFAEEGPKLVAASKAALGL

SEQ ID NO: 134 - protein, 16 aa, Artificial Sequence
  Synthetic peptide
RDWDFDVFGGGTPVGG

SEQ ID NO: 135 - protein, 16 aa, Artificial Sequence
  Synthetic peptide
  misc_feature (12)..(12): Xaa can be any naturally occurring amino acid
QRFVTGHFGGLXPANG

SEQ ID NO: 136 - protein, 16 aa, Artificial Sequence
  Synthetic peptide
QRFVTGHFGGLYPANG

SEQ ID NO: 137 - protein, 16 aa, Artificial Sequence
  Synthetic peptide
QRFVTGHFGGLHPANG

SEQ ID NO: 138 - protein, 9 aa, Artificial Sequence
  Synthetic peptide
TGHFGGLHP

SEQ ID NO: 139 - protein, 16 aa, Artificial Sequence
  Synthetic peptide
QRFCTGHFGGLHPCNG

SEQ ID NO: 140 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 141 - protein, 333 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 142 - protein, 330 aa, Artificial Sequence
  Synthetic peptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 143 - protein, 338 aa, Artificial Sequence
  Synthetic peptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSEPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 144 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 145 - protein, 227 aa, Artificial Sequence
  Synthetic peptide
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 146 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 147 - protein, 232 aa, Artificial Sequence
  Synthetic peptide
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 148 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 149 - protein, 232 aa, Artificial Sequence
  Synthetic peptide
EPKSSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 150 - protein, 217 aa, Artificial Sequence
  Synthetic peptide
APELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVTTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 151 - protein, 7 aa, Artificial Sequence
  Synthetic peptide
SSSYYWG

SEQ ID NO: 152 - protein, 16 aa, Artificial Sequence
  Synthetic peptide
SIYYSGITNYNPSLKS

SEQ ID NO: 153 - protein, 9 aa, Artificial Sequence
  Synthetic peptide
PSNYDAFDI

SEQ ID NO: 154 - protein, 14 aa, Artificial Sequence
  Synthetic peptide
TGSSSNIGAGYDVH

SEQ ID NO: 155 - protein, 7 aa, Artificial Sequence
  Synthetic peptide
GNSKRPS

SEQ ID NO: 156 - protein, 11 aa, Artificial Sequence
  Synthetic peptide
QSYDSSLGGWV

SEQ ID NO: 157 - protein, 119 aa, Artificial Sequence
  Synthetic peptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSS

SEQ ID NO: 158 - protein, 111 aa, Artificial Sequence
  Synthetic peptide
QSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 159 - protein, 245 aa, Artificial Sequence
  Synthetic peptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVL

SEQ ID NO: 160 - protein, 500 aa, Artificial Sequence
  Synthetic peptide
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 161 - protein, 5 aa, Artificial Sequence
  Synthetic peptide
DHYMS

SEQ ID NO: 162 - protein, 17 aa, Artificial Sequence
  Synthetic peptide
YISSSGSTIYYADSVKG

SEQ ID NO: 163 - protein, 8 aa, Artificial Sequence
  Synthetic peptide
DLGPSFDY

SEQ ID NO: 164 - protein, 11 aa, Artificial Sequence
  Synthetic peptide
RASQGISSWLA

SEQ ID NO: 165 - protein, 7 aa, Artificial Sequence
  Synthetic peptide
AASRLQS

SEQ ID NO: 166 - protein, 9 aa, Artificial Sequence
  Synthetic peptide
QQANSFPRT

SEQ ID NO: 167 - protein, 117 aa, Artificial Sequence
  Synthetic peptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSS

SEQ ID NO: 168 - protein, 107 aa, Artificial Sequence
  Synthetic peptide
DIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIK

SEQ ID NO: 169 - protein, 239 aa, Artificial Sequence
  Synthetic peptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIK

SEQ ID NO: 170 - protein, 494 aa, Artificial Sequence
  Synthetic peptide
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 171 - protein, 5 aa, Artificial Sequence
  Synthetic peptide
DYYMT

SEQ ID NO: 172 - protein, 17 aa, Artificial Sequence
  Synthetic peptide
YISSSGSTIYYADSVKG

SEQ ID NO: 173 - protein, 8 aa, Artificial Sequence
  Synthetic peptide
DRNSHFDY

SEQ ID NO: 174 - protein, 11 aa, Artificial Sequence
  Synthetic peptide
RASQGITRWLA

SEQ ID NO: 175 - protein, 7 aa, Artificial Sequence
  Synthetic peptide
AASVLQS

SEQ ID NO: 176 - protein, 9 aa, Artificial Sequence
  Synthetic peptide
QQSNSFPRT

SEQ ID NO: 177 - protein, 117 aa, Artificial Sequence
  Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSS

SEQ ID NO: 178 - protein, 107 aa, Artificial Sequence
  Synthetic peptide
DIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 179 - protein, 239 aa, Artificial Sequence
  Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIK

SEQ ID NO: 180 - protein, 494 aa, Artificial Sequence
  Synthetic peptide
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 181 - protein, 5 aa, Artificial Sequence
  Synthetic peptide
DYYMT

SEQ ID NO: 182 - protein, 17 aa, Artificial Sequence
  Synthetic peptide
YISSSGSTIYYADSVKG

SEQ ID NO: 183 - protein, 8 aa, Artificial Sequence
  Synthetic peptide
DRNSHFDY

SEQ ID NO: 184 - protein, 11 aa, Artificial Sequence
  Synthetic peptide
RASQGINTWLA

SEQ ID NO: 185 - protein, 7 aa, Artificial Sequence
  Synthetic peptide
GASGLQS

SEQ ID NO: 186 - protein, 9 aa, Artificial Sequence
  Synthetic peptide
QQAKSFPRT

SEQ ID NO: 187 - protein, 117 aa, Artificial Sequence
  Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSS

SEQ ID NO: 188 - protein, 107 aa, Artificial Sequence
  Synthetic peptide
DIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 189 - protein, 239 aa, Artificial Sequence
  Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIK

SEQ ID NO: 190 - protein, 494 aa, Artificial Sequence
  Synthetic peptide
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 191 - protein, 5 aa, Artificial Sequence
  Synthetic peptide
DHYMS

SEQ ID NO: 192 - protein, 17 aa, Artificial Sequence
  Synthetic peptide
YISSSGGIIYYADSVKG

SEQ ID NO: 193 - protein, 8 aa, Artificial Sequence
  Synthetic peptide
DVGSHFDY

SEQ ID NO: 194 - protein, 11 aa, Artificial Sequence
  Synthetic peptide
RASQDISRWLA

SEQ ID NO: 195 - protein, 7 aa, Artificial Sequence
  Synthetic peptide
AASRLQS

SEQ ID NO: 196 - protein, 9 aa, Artificial Sequence
  Synthetic peptide
QQAKSFPRT

SEQ ID NO: 197 - protein, 117 aa, Artificial Sequence
  Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSS

SEQ ID NO: 198 - protein, 107 aa, Artificial Sequence
  Synthetic peptide
DIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 199 - protein, 239 aa, Artificial Sequence
  Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIK

SEQ ID NO: 200 - protein, 494 aa, Artificial Sequence
  Synthetic peptide
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 201 - protein, 5 aa, Artificial Sequence
  Synthetic peptide
DHYMS

SEQ ID NO: 202 - protein, 17 aa, Artificial Sequence
  Synthetic peptide
YISNSGSIIYYVDSVKG

SEQ ID NO: 203 - protein, 8 aa, Artificial Sequence
  Synthetic peptide
DVRTAFDY

SEQ ID NO: 204 - protein, 11 aa, Artificial Sequence
  Synthetic peptide
RASQSIGSWLA

SEQ ID NO: 205 - protein, 7 aa, Artificial Sequence
  Synthetic peptide
AASSLQS

SEQ ID NO: 206 - protein, 9 aa, Artificial Sequence
  Synthetic peptide
QQANSFPRT

SEQ ID NO: 207 - protein, 117 aa, Artificial Sequence
  Synthetic peptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSS

SEQ ID NO: 208 - protein, 107 aa, Artificial Sequence
  Synthetic peptide
DIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK

SEQ ID NO: 209 - protein, 239 aa, Artificial Sequence
  Synthetic peptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIK

SEQ ID NO: 210 - protein, 494 aa, Artificial Sequence
  Synthetic peptide
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 211 - protein, 5 aa, Artificial Sequence
  Synthetic peptide
SKFMT

SEQ ID NO: 212 - protein, 16 aa, Artificial Sequence
  Synthetic peptide
VIYSGGKTYYADSVKG

SEQ ID NO: 213 - protein, 10 aa, Artificial Sequence
  Synthetic peptide
DSGGWGYFDY

SEQ ID NO: 214 - protein, 17 aa, Artificial Sequence
  Synthetic peptide
KSSQSVLYSSNNKNYLA

SEQ ID NO: 215 - protein, 7 aa, Artificial Sequence
  Synthetic peptide
WASTRES

SEQ ID NO: 216 - protein, 9 aa, Artificial Sequence
  Synthetic peptide
QQYYSTPPT

SEQ ID NO: 217 - protein, 118 aa, Artificial Sequence
  Synthetic peptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSS

SEQ ID NO: 218 - protein, 113 aa, Artificial Sequence
  Synthetic peptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 219 - protein, 246 aa, Artificial Sequence
  Synthetic peptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 220 - protein, 501 aa, Artificial Sequence
  Synthetic peptide
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 221 - protein, 5 aa, Artificial Sequence
  Synthetic peptide
SYYWN

SEQ ID NO: 222 - protein, 16 aa, Artificial Sequence
  Synthetic peptide
RIYYNGNTYYNPSLKS

SEQ ID NO: 223 - protein, 10 aa, Artificial Sequence
  Synthetic peptide
PKLGIDAFDI

SEQ ID NO: 224 - protein, 14 aa, Artificial Sequence
  Synthetic peptide
TGSSSNIGAGYDVH

SEQ ID NO: 225 - protein, 7 aa, Artificial Sequence
  Synthetic peptide
GNSNRPS

SEQ ID NO: 226 - protein, 11 aa, Artificial Sequence
  Synthetic peptide
QSYDSSLSGWV

SEQ ID NO: 227 - protein, 118 aa, Artificial Sequence
  Synthetic peptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSS

SEQ ID NO: 228 - protein, 111 aa, Artificial Sequence
  Synthetic peptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 229 - protein, 244 aa, Artificial Sequence
  Synthetic peptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVL

SEQ ID NO: 230 - protein, 499 aa, Artificial Sequence
  Synthetic peptide
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 231 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 232 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 233 - protein, 622 aa, Homo sapiens [sequence omitted]

SEQ ID NO: 234 - protein, 622 aa, Macaca fascicularis
MALPMARPLSGSCGTPALGSLLFLLFSLGWVQPSRVLAGETRQEAAPLDGILTNAPDIASLSPRQLLGFTCVEVSGLSTELVQELAVALGQKNVKLSAEQLRCLAHRLSEPPEDLDALPLDLLLFLNPDAFSGPQACTHFFSRVAKANVDLLPRGAPERQRLLPAALTCWGVRGSLLSEADVRALGGLACDLPGRFVAESAEVVLPRLVRCLGPLDQDQQEAARAALQRGGPPYGPPSTWSISTLDDLQSLLPVLGQPVIHSIPQGILAAWRQRSSRDPSWQQPEQTVLRPRFRRDVERTTCPPEKEVHEIDENLIFYKKRELEACVDAALLAAQMDRVDAIPFTYEQLDVLKHKLDELYPQGYPESVIRHLGHLFLKMSPEDIRKWNVTSLETLKALLKVSKGHEMSAQVATLIDRVVVGRGQLDKDTADTLTAFCPGCLCSLSPERLSSVPPSVIGAVRPQDLDTCGPRQLDVLYPKARLAFQNMSGSEYFVKIRPFLGGAPTEDLKALSQQNVSMDLATFMKLRREAVLPLTVAEVQKLLGPHVEGLKVEEQHSPVRDWILKQRQDDLDTLGLGLQGGIPNGYLILDLSVREALSGTPCLLGPGPVLTILALLLASTLA

SEQ ID NO: 235 - protein, 286 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPER

SEQ ID NO: 236 - protein, 303 aa, Homo sapiens
EVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALS

SEQ ID NO: 237 - protein, 24 aa, Homo sapiens
GTPCLLGPGPVLTVLALLLASTLA

SEQ ID NO: 238 - protein, 51 aa, Homo sapiens
EVEKTACPSGKKAREIDESLIFYKKWELEACVDAALLATQMDRVNAIPFTY

SEQ ID NO: 239 - protein, 38 aa, Homo sapiens
EQLDVLKHKLDELYPQGYPESVIQHLGYLFLKMSPEDI

SEQ ID NO: 240 - protein, 69 aa, Homo sapiens
RKWNVTSLETLKALLEVNKGHEMSPQVATLIDRFVKGRGQLDKDTLDTLTAFYPGYLCSLSPEELSSVP

SEQ ID NO: 241 - protein, 48 aa, Homo sapiens
PSSIWAVRPQDLDTCDPRQLDVLYPKARLAFQNMNGSEYFVKIQSFLG

SEQ ID NO: 242 - protein, 44 aa, Homo sapiens
GAPTEDLKALSQQNVSMDLATFMKLRTDAVLPLTVAEVQKLLGP

SEQ ID NO: 243 - protein, 52 aa, Homo sapiens
HVEGLKAEERHRPVRDWILRQRQDDLDTLGLGLQGGIPNGYLVLDLSMQEAL

SEQ ID NO: 244 - protein, 89 aa, Homo sapiens
EVEKTACPSGKKAREIDESLIFYKKWELEACVDAALLATQMDRVNAIPFTYEQLDVLKHKLDELYPQGYPESVIQHLGYLFLKMSPEDI

SEQ ID NO: 245 - protein, 107 aa, Homo sapiens
EQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVP

SEQ ID NO: 246 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRRDAEQKACPPGKEPYKVDEDLIFYQNWELEACVDGTMLARQMDLVNEIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 247 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLSIFKHKLDKTYPQGYPESLIQQLGHFFRYVSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 248 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIHQWNVTSPDTVKTLLKVSKGQKMNAQAIALVACYLRGGGQLDEDMVKALGDIPLSYLCDFSPQDLHSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 249 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPSSVMWLVGPQDLDKCSQRHLGLLYQKACSAFQNVSGLEYFEKIKTFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 250 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGASVKDLRALSQHNVSMDIATFKRLQVDSLVGLSVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 251 - protein, 622 aa, Artificial Sequence
  Synthetic peptide
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPNIVDLKTEEDKSPVRDWLFRQHQKDLDRLGLGLQGGIPNGYLVLDFNVREAFSGTPCLLGPGPVLTVLALLLASTLA

SEQ ID NO: 252 - protein, 227 aa, artificial
  Fc monomer-1
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 225 aa, artificial
  Fc monomer-2
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 254 - protein, 227 aa, artificial
  Fc monomer-3
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 225 aa, artificial
  Fc monomer-4
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 256 - protein, 227 aa, artificial
  Fc monomer-5
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 257 - protein, 225 aa, artificial
  Fc monomer-6
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 258 - protein, 227 aa, artificial
  Fc monomer-7
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 259 - protein, 225 aa, artificial
  Fc monomer-8
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 260 - protein, 484 aa, artificial
  scFc-1
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 480 aa, artificial
  scFc-2
DKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 262 - protein, 484 aa, artificial
  scFc-3
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 263 - protein, 480 aa, artificial
  scFc-4
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 264 - protein, 484 aa, artificial
  scFc-5
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - protein, 480 aa, artificial
  scFc-6
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 266 - protein, 484 aa, artificial
  scFc-7
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - protein, 480 aa, artificial
  scFc-8
DKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYNSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSP

SEQ ID NO: 268 - protein, 988 aa, artificial
  MS_1xCD3-scFc
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 269 - protein, 986 aa, artificial
  MS_1xCD3-scFc_delGK
QVQLQESGPGLVKPSETLSLTCTVSGGSISSSSYYWGWIRQPPGKGLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 988 aa, artificial
  MS_1_CCxCD3-scFc
QVQLQESGPGLVKPSETLSLTCTVSGGSISSSSYYWGWIRQPPGKCLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 271 - protein, 986 aa, artificial
  MS_1_CCxCD3-scFc_delGK
QVQLQESGPGLVKPSETLSLTCTVSGGSISSSSYYWGWIRQPPGKCLEWIGSIYYSGITNYNPSLKSRVTISVDTSKNQFSLKLSSVTAADTAVYYCARPSNYDAFDIWGQGTMVTVSSGGGGSGGGGSGGGGSQSVLTQPPSVSGAPGQRVTISCTGSSSNIGAGYDVHWYQQVPGTAPKLLIYGNSKRPSGVPDRFSGSKSGTSASLAITGLQAEDEADYYCQSYDSSLGGWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 272 - protein, 982 aa, artificial
  MS_2xCD3-scFc
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 273 - protein, 980 aa, artificial
  MS_2xCD3-scFc_delGK
QVQLVESGGGVVQPGRSLRLSCAASGFTFSDHYMSWIRQTPGKGLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 274 - protein, 982 aa, artificial
  MS_2_CCxCD3-scFc
QVQLVESGGGVVQPGRSLRLSCAASGFTFSDHYMSWIRQTPGKCLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 275 - protein, 980 aa, artificial
  MS_2_CCxCD3-scFc_delGK
QVQLVESGGGVVQPGRSLRLSCAASGFTFSDHYMSWIRQTPGKCLEWVSYISSSGSTIYYADSVKGRFTISRDNAKNSLYLQMNSLRAEDTAVYYCARDLGPSFDYWGQGSLVTVSSGGGGSGGGGSGGGGSDIQMTQSPSSVSASVGDRVTITCRASQGISSWLAWYQQKPGKAPKLLIDAASRLQSGVPSRFSGSGSGTDFTLTISSLQPEDFATYYCQQANSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 982 aa, artificial
  MS_3xCD3-scFc
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 277 - protein, 980 aa, artificial
  MS_3xCD3-scFc_delGK
QVQLVESGGGLVKPGGSLRLSCAASGFTFSDYYMTWIRQAPGKGLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 278 - protein, 982 aa, artificial
  MS_3_CCxCD3-scFc
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 279 - protein, 980 aa, artificial
  MS_3_CCxCD3-scFc_delGK
QVQLVESGGGLVKPGGSLRLSCAASGFTFSDYYMTWIRQAPGKCLEWISYISSSGSTIYYADSVKGRFTISRDNAKNSLYLQMNSLRAEDTAVYYCARDRNSHFDYWGQGTLVTVSSGGGGSGGGGSGGGGSDIQMTQSPSSVSASVGDRVTITCRASQGITRWLAWYQQKPGKAPKLLIYAASVLQSGVPSRFSGSGSGTDFTLTISSLQPEDFATYYCQQSNSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 280 - protein, 982 aa, artificial
  MS_4xCD3-scFc
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 980 aa, artificial
  MS_4xCD3-scFc_delGK
QVQLVESGGGLVKPGGSLRLSCAASGFTFSDYYMTWIRQAPGKGLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 982 aa, artificial
  MS_4_CCxCD3-scFc
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 980 aa, artificial
  MS_4_CCxCD3-scFc_delGK
QVQLVESGGGLVKPGGSLRLSCAASGFTFSDYYMTWIRQAPGKCLEWLSYISSSGSTIYYADSVKGRFTISRDNAKNSLFLQMNSLRAEDTAVYYCARDRNSHFDYWGQGTLVTVSSGGGGSGGGGSGGGGSDIQMTQSPSSVSASVGDRVTITCRASQGINTWLAWYQQKPGKAPKLLIYGASGLQSGVPSRFSGSGSGTDFTLTISSLQPEDFATYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 982 aa, artificial
  MS_5xCD3-scFc
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 980 aa, artificial
  MS_5xCD3-scFc_delGK
QVQLVESGGGLVKPGGSLRLSCAASGFTFSDHYMSWIRQAPGKGLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 982 aa, artificial
  MS_5_CCxCD3-scFc
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 980 aa, artificial
  MS_5_CCxCD3-scFc_delGK
QVQLVESGGGLVKPGGSLRLSCAASGFTFSDHYMSWIRQAPGKCLEWFSYISSSGGIIYYADSVKGRFTISRDNAKNSLYLQMNSLRAEDTAVYYCARDVGSHFDYWGQGTLVTVSSGGGGSGGGGSGGGGSDIQMTQSPSSVSASVGDRVTITCRASQDISRWLAWYQQKPGKAPKLLISAASRLQSGVPSRFSGSGSGTDFTLTISSLQPEDFAIYYCQQAKSFPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 982 aa, artificial
  MS_6xCD3-scFc
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 980 aa, artificial
  MS_6xCD3-scFc_delGK
QVQLVESGGGLVKPGGSLRLSCAASGFTFSDHYMSWIRQAPGKGLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 982 aa, artificial
  MS_6_CCxCD3-scFc
QVQLVESGGGLVKPGGSLRLSCAASGFTFSDHYMSWIRQAPGKCLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 980 aa, artificial
  MS_6_CCxCD3-scFc_delGK
QVQLVESGGGLVKPGGSLRLSCAASGFTFSDHYMSWIRQAPGKCLEWISYISNSGSIIYYVDSVKGRFTISRDNAKNSLYLQMNSLRAEDTAVYYCARDVRTAFDYWGQGTLVTVSSGGGGSGGGGSGGGGSDIQMTQSPSSVSASVGDRVTITCRASQSIGSWLAWYQQKPGKAPNLLIYAASSLQSGVPSRFSGSGSGTDFTLTISSLQPEDFATYYCQQANSFPRTFGCGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 989 aa, artificial
  MS_7xCD3-scFc
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 987 aa, artificial
  MS_7xCD3-scFc_delGK
EVQLVESGGGLIQPGGSLRLSCAVSGFTVSSKFMTWVRQAPGKGLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 989 aa, artificial
  MS_7_CCxCD3-scFc
EVQLVESGGGLIQPGGSLRLSCAVSGFTVSSKFMTWVRQAPGKCLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 987 aa, artificial
  MS_7_CCxCD3-scFc_delGK
EVQLVESGGGLIQPGGSLRLSCAVSGFTVSSKFMTWVRQAPGKCLEWVSVIYSGGKTYYADSVKGRFTISRDNSKNTLYLQMNSLRAEDTAVYYCARDSGGWGYFDYWGQGTLVTVSSGGGGSGGGGSGGGGSDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 987 aa, artificial
  MS_8xCD3-scFc
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 985 aa, artificial
  MS_8xCD3-scFc_delGK
QVQLQESGPGLVKPSETLSLTCTVSGGSISSYYWNWIRQPPGKGLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 987 aa, artificial
  MS_8_CCxCD3-scFc
QVQLQESGPGLVKPSETLSLTCTVSGGSISSYYWNWIRQPPGKCLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 985 aa, artificial
  MS_8_CCxCD3-scFc_delGK
QVQLQESGPGLVKPSETLSLTCTVSGGSISSYYWNWIRQPPGKCLEWIGRIYYNGNTYYNPSLKSRVTISGDTSKNQFSLKLSSVTAADTAVYYCARPKLGIDAFDIWGQGTMVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 20 aa, artificial
  (G4S)4 linker
GGGGSGGGGSGGGGSGGGGS

SEQ ID NO: 301 - protein, 25 aa, artificial
  (G4S)5 linker
GGGGSGGGGSGGGGSGGGGSGGGGS

SEQ ID NO: 302 - protein, 30 aa, artificial
  (G4S)6 linker
GGGGSGGGGSGGGGSGGGGSGGGGSGGGGS

SEQ ID NO: 303 - protein, 35 aa, artificial
  (G4S)7 linker
GGGGSGGGGSGGGGSGGGGSGGGGSGGGGSGGGGS

SEQ ID NO: 304 - protein, 40 aa, artificial
  (G4S)8 linker
GGGGSGGGGSGGGGSGGGGSGGGGSGGGGSGGGGSGGGGS

SEQ ID NO: 305 - protein, 109 aa, Artificial Sequence
  Synthetic Peptide
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 306 - protein, 109 aa, Artificial Sequence
  Synthetic Peptide
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 307 - protein, 109 aa, Artificial Sequence
  Synthetic Peptide
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 308 - protein, 125 aa, Artificial Sequence
  Synthetic Peptide
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 309 - protein, 125 aa, Artificial Sequence
  Synthetic Peptide
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 310 - protein, 125 aa, Artificial Sequence
  Synthetic peptide
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 311 - protein, 125 aa, Artificial Sequence
  Synthetic Peptide
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 312 - protein, 125 aa, Artificial Sequence
  Synthetic Peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 313 - protein, 125 aa, Artificial Sequence
  Synthetic Peptide
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 314 - protein, 125 aa, Artificial Sequence
  Synthetic Peptide
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 315 - protein, 125 aa, Artificial Sequence
  Synthetic Peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 316 - protein, 125 aa, Artificial Sequence
  Synthetic peptide
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 317 - protein, 125 aa, Artificial Sequence; identical to SEQ ID NO: 309
  Synthetic Peptide

SEQ ID NO: 318 - protein, 249 aa, Artificial Sequence
  Synthetic Peptide
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 319 - protein, 249 aa, Artificial Sequence
  Synthetic Peptide
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 320 - protein, 249 aa, Artificial Sequence
  Synthetic Peptide
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 321 - protein, 249 aa, Artificial Sequence
  Synthetic Peptide
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 322 - protein, 249 aa, Artificial Sequence
  Synthetic Peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 323 - protein, 249 aa, Artificial Sequence
  Synthetic Peptide
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 324 - protein, 249 aa, Artificial Sequence
  Synthetic Peptide
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 325 - protein, 249 aa, Artificial Sequence
  Synthetic Peptide
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 326 - protein, 249 aa, Artificial Sequence
  Synthetic Peptide
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 327 - protein, 249 aa, Artificial Sequence; identical to SEQ ID NO: 326
  Synthetic Peptide

The invention claimed is:

1. A bispecific antibody construct comprising a first binding domain which binds to human mesothelin (MSLN) on the surface of a target cell and a second binding domain which binds to human CD3 epsilon on the surface of a T cell, wherein the first binding domain comprises a VH region comprising CDR-H1, CDR-H2 and CDR-H3 and a VL region comprising CDR-L1, CDR-L2 and CDR-L3, wherein said CDR-H1, CDR-H2, CDR-H3, CDR-L1, CDR-L2, and CDR-L3 comprise the amino acid sequences selected from the group consisting of:
   a) the amino acid sequences of SEQ ID NO: 161 (CDR-H1), SEQ ID NO: 162 (CDR-H2), SEQ ID NO: 163 (CDR-H3), SEQ ID NO: 164 (CDR-L1), SEQ ID NO: 165 (CDR-L2), and SEQ ID NO: 166 (CDR-L3);
   b) the amino acid sequences of SEQ ID NO: 171 (CDR-H1), SEQ ID NO: 172 (CDR-H2), SEQ ID NO: 173 (CDR-H3), SEQ ID NO: 174 (CDR-L1), SEQ ID NO: 175 (CDR-L2), and SEQ ID NO: 176 (CDR-L3);
   c) the amino acid sequences of SEQ ID NO: 181 (CDR-H1), SEQ ID NO: 182 (CDR-H2), SEQ ID NO: 183 (CDR-H3), SEQ ID NO: 184 (CDR-L1), SEQ ID NO: 185 (CDR-L2), and SEQ ID NO: 186 (CDR-L3);
   d) the amino acid sequences of SEQ ID NO: 191 (CDR-H1), SEQ ID NO: 192 (CDR-H2), SEQ ID NO: 193 (CDR-H3), SEQ ID NO: 194 (CDR-L1), SEQ ID NO: 195 (CDR-L2), and SEQ ID NO: 196 (CDR-L3); and
   e) the amino acid sequences of SEQ ID NO: 201 (CDR-H1), SEQ ID NO: 202 (CDR-H2), SEQ ID NO: 203 (CDR-H3), SEQ ID NO: 204 (CDR-L1), SEQ ID NO: 205 (CDR-L2), and SEQ ID NO: 206 (CDR-L3), and
   wherein the second binding domain comprises a heavy chain variable (VH) region and a light chain variable (VL) region.

2. The bispecific antibody construct according to claim 1, wherein the antibody construct is an (scFv)$_2$, a diabody, or an oligomer thereof.

3. The bispecific antibody construct according to claim 1, wherein the first binding domain comprises a VH region and a VL region comprising the pair of amino acid sequences, respectively, selected from the group consisting of: SEQ ID NOs: 167 and 168, SEQ ID NOs: 177 and 178, SEQ ID NOs: 187 and 188, SEQ ID NOs: 197 and 198, and SEQ ID NOs: 207 and 208.

4. The bispecific antibody construct according to claim 1, wherein the first binding domain comprises the amino acid sequence selected from the group consisting of: SEQ ID NO: 169, SEQ ID NO: 179, SEQ ID NO: 189, SEQ ID NO: 199, and SEQ ID NO: 209.

5. The bispecific antibody construct according to claim 1 comprising in an N- to C-terminal order:
   (a) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
   a peptide linker comprising the amino acid sequence selected from the group consisting of: SEQ ID NOs: 1-9; and
   the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
   optionally, a His-tag comprising the amino acid sequence of SEQ ID NO: 10;
   (b) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
   a peptide linker comprising the amino acid sequence selected from the group consisting of: SEQ ID NOs: 1-9;
   the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103;
   optionally, a peptide linker comprising the amino acid sequence selected from the group consisting: of SEQ ID NOs: 1-9; and
   an albumin polypeptide comprising the amino acid sequence selected from the group consisting of: SEQ ID NOs: 104-133; and
   optionally, a His-tag comprising the amino acid sequence of SEQ ID NO: 10;
   (c) a neonatal Fc receptor (FcRn) binding peptide comprising the amino acid sequence of QRFVTGHFGGLX$_1$PANG (SEQ ID NO: 135) whereas X1 is Y or H;
   the first binding domain comprising the amino acid sequence selected from the group consisting of: SEQ ID NO: 169, SEQ ID NO: 179, SEQ ID NO: 189, SEQ ID NO: 199, and SEQ ID NO: 209;
   a peptide linker comprising the amino acid sequence selected from the group consisting of: SEQ ID NOs: 1-9;
   the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
   a neonatal Fc receptor (FcRn) binding peptide comprising the amino acid sequence of QRFVTGHFG- GLHPANG (SEQ ID NO: 137) or QRFCTGHFG-GLHPCNG (SEQ ID NO: 139); and
optionally, a His-tag comprising the amino acid sequence of SEQ ID NO: 10;
(d) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
a peptide linker comprising the amino acid sequence selected from the group consisting of: SEQ ID NOs: 1-9;
the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
a Fc polypeptide comprising the amino acid sequence of SEQ ID NO: 144; and a Fc polypeptide comprising the amino acid sequence of SEQ ID NO: 145;
(e) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
a Fc polypeptide comprising the amino acid sequence of SEQ ID NO: 146;
the second binding domain polypeptide comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
a Fc polypeptide comprising the amino acid sequence of SEQ ID NO: 147;
(f) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
a Fc polypeptide comprising the amino acid sequence of SEQ ID NO: 148;
the second binding domain polypeptide comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
a Fc polypeptide comprising the amino acid sequence of SEQ ID NO: 149; or
(g) the first binding domain comprising the amino acid sequence selected from the group consisting of: SEQ ID NO: 169, SEQ ID NO: 179, SEQ ID NO: 189, SEQ ID NO: 199, and SEQ ID NO: 209;
a peptide linker comprising the amino acid sequence selected from the group consisting of: SEQ ID NOs: 1-9;
the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, and SEQ ID NO: 103; and
a Fc polypeptide comprising the amino acid sequence of SEQ ID NO: 150.

6. The bispecific antibody construct according to claim 1 comprising in an N- to C-terminal order:
the first binding domain comprising the amino acid sequence selected from the group consisting of: SEQ ID NO: 169, SEQ ID NO: 179, SEQ ID NO: 189, SEQ ID NO: 199, and SEQ ID NO: 209;
a peptide linker comprising the amino acid sequence selected from the group consisting of: SEQ ID NOs: 2, 8 and 9;
the second binding domain comprising the amino acid sequence selected from the group consisting of: SEQ ID NO: 19, SEQ ID NO: 28, SEQ ID NO: 37, SEQ ID NO: 46, SEQ ID NO: 55, SEQ ID NO: 64, SEQ ID NO: 73, SEQ ID NO: 82, SEQ ID NO: 91, SEQ ID NO: 100, SEQ ID NO: 103, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, and SEQ ID NO: 327;
a peptide linker comprising the amino acid sequence selected from the group consisting of: SEQ ID NOs: 1, 2, 4, 5, 6, 8 and 9; and
a third domain comprising the amino acid sequence selected from the group consisting of: SEQ ID NOs: 260-267.

7. The bispecific antibody construct according to claim 6, comprising a sequence selected from the group consisting of: SEQ ID NOs: 276-287.

8. The bispecific antibody construct according to claim 1, wherein the second binding domain comprises
(a) a VL region comprising CDR-L1, CDR-L2 and CDR-L3 comprising:
(i) CDR-L1 comprising the amino acid sequence set forth in SEQ ID NO: 20, CDR-L2 comprising the amino acid sequence set forth in SEQ ID 21 and CDR-L3 comprising the amino acid sequence set forth in SEQ ID NO: 22;
(ii) CDR-L1 comprising the amino acid sequence set forth in SEQ ID NO: 65, CDR-L2 comprising the amino acid sequence set forth in SEQ ID NO: 66 and CDR-L3 comprising the amino acid sequence set forth in SEQ ID NO: 67; or
(iii) CDR-L1 comprising the amino acid sequence set forth in SEQ ID NO: 83, CDR-L2 comprising the amino acid sequence set forth in SEQ ID NO: 84 and CDR-L3 comprising the amino acid sequence set forth in SEQ ID NO: 85; and
(b) a VH region comprising CDR-L1, CDR-L2 and CDR-L3 comprising:
(i) CDR-H1 comprising the amino acid sequence set forth in SEQ ID NO: 14, CDR-H2 comprising the amino acid sequence set forth in SEQ ID NO: 15 and CDR-H3 comprising the amino acid sequence set forth in SEQ ID NO: 16;
(ii) CDR-H1 comprising the amino acid sequence set forth in SEQ ID NO: 23, CDR-H2 comprising the amino acid sequence set forth in SEQ ID NO: 24 and CDR-H3 comprising the amino acid sequence set forth in SEQ ID NO: 25;
(iii) CDR-H1 comprising the amino acid sequence set forth in SEQ ID NO: 32, CDR-H2 comprising the amino acid sequence set forth in SEQ ID NO: 33 and CDR-H3 comprising the amino acid sequence set forth in SEQ ID NO: 34;
(iv) CDR-H1 comprising the amino acid sequence set forth in SEQ ID NO: 66 of SEQ ID NO: 41, CDR-H2 comprising the amino acid sequence set forth in SEQ ID NO: 42 and CDR-H3 comprising the amino acid sequence set forth in SEQ ID NO: 43;
(v) CDR-H1 comprising the amino acid sequence set forth in SEQ ID NO: 50, CDR-H2 comprising the amino acid sequence set forth in SEQ ID NO: 51 and CDR-H3 comprising the amino acid sequence set forth in SEQ ID NO: 52;

(vi) CDR-H1 comprising the amino acid sequence set forth in SEQ ID NO: 59, CDR-H2 comprising the amino acid sequence set forth in SEQ ID NO: 60 and CDR-H3 comprising the amino acid sequence set forth in SEQ ID NO: 61;

(vii) CDR-H1 comprising the amino acid sequence set forth in SEQ ID NO: 68, CDR-H2 comprising the amino acid sequence set forth in SEQ ID NO: 69 and CDR-H3 comprising the amino acid sequence set forth in SEQ ID NO: 70;

(viii) CDR-H1 comprising the amino acid sequence set forth in SEQ ID NO: 77, CDR-H2 comprising the amino acid sequence set forth in SEQ ID NO: 78 and CDR-H3 comprising the amino acid sequence set forth in SEQ ID NO: 79;

(ix) CDR-H1 comprising the amino acid sequence set forth in SEQ ID NO: 86, CDR-H2 comprising the amino acid sequence set forth in SEQ ID NO: 87 and CDR-H3 comprising the amino acid sequence set forth in SEQ ID NO: 88; or (x) CDR-H1 comprising the amino acid sequence set forth in SEQ ID NO: 95, CDR-H2 comprising the amino acid sequence set forth in SEQ ID NO: 96 and CDR-H3 comprising the amino acid sequence set forth in SEQ ID NO: 97.

9. The bispecific antibody construct according to claim 1, wherein the second binding domain comprises (a) a VL region comprising the amino acid sequence set forth in SEQ ID NO: 18, 27, 36, 45, 54, 63, 72, 81, 90, 99, or 102; and (b) a VH region comprising the amino acid sequence set forth in SEQ ID NO: 17, 26, 35, 44, 53, 62, 71, 80, 89, 98, or 101.

10. The bispecific antibody construct according to claim 1, wherein the second binding domain comprises (a) a VL region comprising the amino acid sequence set forth in SEQ ID NO: 18 and a VH region comprising the amino acid sequence set forth in SEQ ID NO: 17;

(b) a VL region comprising the amino acid sequence set forth in SEQ ID NO: 27 and a VH region comprising the amino acid sequence set forth in SEQ ID NO: 26;

(c) a VL region comprising the amino acid sequence set forth in SEQ ID NO: 36 and a VH region comprising the amino acid sequence set forth in SEQ ID NO: 35;

(d) a VL region comprising the amino acid sequence set forth in SEQ ID NO: 45 and a VH region comprising the amino acid sequence set forth in SEQ ID NO: 44;

(e) a VL region comprising the amino acid sequence set forth in SEQ ID NO: 54 and a VH region comprising the amino acid sequence set forth in SEQ ID NO: 53;

(f) a VL region comprising the amino acid sequence set forth in SEQ ID NO: 63 and a VH region comprising the amino acid sequence set forth in SEQ ID NO: 62;

(g) a VL region comprising the amino acid sequence set forth in SEQ ID NO: 72 and a VH region comprising the amino acid sequence set forth in SEQ ID NO: 71;

(h) a VL region comprising the amino acid sequence set forth in SEQ ID NO: 81 and a VH region comprising the amino acid sequence set forth in SEQ ID NO: 80;

(i) a VL region comprising the amino acid sequence set forth in SEQ ID NO: 90 and a VH region comprising the amino acid sequence set forth in SEQ ID NO: 89;

(j) a VL region comprising the amino acid sequence set forth in SEQ ID NO: 99 and a VH region comprising the amino acid sequence set forth in SEQ ID NO: 98; or (k) a VL region comprising the amino acid sequence set forth in SEQ ID NO: 102 and a VH region comprising the amino acid sequence set forth in SEQ ID NO: 101.

11. The bispecific antibody construct according to claim 1, wherein the first binding domain further binds to macaque mesothelin (MSLN) on the surface of a target cell.

12. The bispecific antibody construct according to claim 11, wherein the ratio of the binding affinity of the first binding domain for macaque MSLN/human MSLN measured via Scatchard analysis is less than 100.

13. The bispecific antibody construct according to claim 12, wherein the ratio is less than 20.

14. The bispecific antibody construct according to claim 12, wherein the ratio is less than 10.

15. The bispecific antibody construct according to claim 12, wherein the ratio is less than 2.

16. The bispecific antibody construct according to claim 1, wherein the second binding domain further binds to *Callithrix jacchus*, *Saguinus oedipus* or *Saimiri sciureus* CD3 epsilon on the surface of a T cell.

17. A polynucleotide encoding the bispecific antibody construct according to claim 1.

18. A vector comprising the polynucleotide according to claim 17.

19. A host cell transformed or transfected with the polynucleotide according to claim 17.

20. A process for producing a bispecific antibody construct comprising a first binding domain which binds to human MSLN on the surface of a target cell and a second binding domain which binds to human CD3 on the surface of a T cell, said process comprising culturing the host cell of claim 19 under conditions allowing the expression of the antibody construct, and recovering the produced antibody construct from the culture.

21. The process of claim 20, wherein the first binding domain further binds to macaque mesothelin (MSLN) on the surface of a target cell.

22. A composition comprising the bispecific antibody construct according to claim 1 and a carrier, stabilizer, excipient, diluent, solubilizer, surfactant, emulsifier, preservative or adjuvant.

23. A kit comprising the bispecific antibody construct according to claim 1 and a recipient and, optionally, directions for use.

\* \* \* \* \*